United States Patent 9,976,180 (METHODS FOR DETECTING A GENETIC VARIATION IN SUBJECTS WITH PARKINSONISM) - sequence listing, part 12

SEQ ID NO: 72 - DNA, 18527786 bp, Homo sapiens (residues 16,469,145-18,527,786 of 18,527,786)
  misc_feature (4041202)..(4061201): n is a, c, g, or t
gctgcatctcaggcctgagaccctgcaaatacggaaacgctgctcttgacagctcagagtccaagtgttccatttcctcctggaggcccgacatggggctctgattgctttgccaggaagaaacggacaaacagttgtgcatacacagatgtggtgggtacggaacatgtggctgtgggtttggggggagaaggggacagctgctggctggaaacagccaggggaggggagctcacccccaggaaaggctcaaggattgtgagaggtggcagctgctgtccacaatacccaggtgacagtggctccacagagaccatcagctccaaaccactcatttcacagccagcaagactaagacccagaagagggaaggagctggcccatgcagacatattctccagtggggaggagagaagtgagaatcaggtctcagtttctcaacagtctccccaaattatttacccatccatacagctgtggggagaggggggttaaaacagaaatcagaccacactactcccgtgcttaaaacctgcaatggctttcactgactcagaataagatctacagtcctcacctcggcacgcaaagccctacaggatctgccctgcccccactatgacaccctcaaactctctctatcactcactctgctctggccacgccagtctcccttcttctctcaaatgagctaagcttgctcccagctcagggcttctgccctttctcaccttggtccagaccaccctccccaagatcatcccattccaacccctcagaaaggccatcccacccttgggttgccagatataaaataaaccccaggatgcccaggtgaatgctcatttcagacacatattttttttagtataagtatgtctcaaatattccataagacatgtttccactaaaaaattatttgatgtttacctgaaattccaatttccctgggtgtcctttgttttcatttgctaaatctagcagccctggccctgacctcccgattgaaagcaacctcaggcagagtcactctttaccacatctgcattttatgttcttcacagtctgcactggcatctgaaatgacctcatttgttaaattaccctctgtttctcccacctacgagccgcgtggcagcacggagcaagtctgtcttacttagtacagcatccccagggtctagtgcagagcctggcacacaggagatgcttactatgtatttcaggagacctcatcacataagagtaaaaaacacagactctacagcctgactgtgtcagctcaaatcctggctctgatgcttcctagctctgtaagcttgccctataacttaatctctctgggccttggtttcctcatctgtaaaatgggtacaataatagtaaccacctttaaagagtgttgtgaagttttaatgaatgcatatctgtaaggcacagagaacagaacccagcacaaagaaaatgtccactcggtgctagtttatgataaactcagtagttagtggttgggttttggggaaagggggtgagggactcttcccccatctgatcagttaggtgacactagcgggctggactgtgggccagggccccttcctctcctggagagcctgtctgcaagagctctgttcccgattagcatctcaccagcccagatgctgccatggccatgggaaaatgtttccaagcagggagtaaatggagtaaacaagcctgggaaggagagtggacccagcacctctttcctttggggctgcagtggatgccatggtgcactcctcaaatgcctgtcacagagacagagacaccccttaccccaggtgctgggagtgctggctgacaatgaccctcagctaaggccctctcctagagctgccttcagcctaagagggccacctgtctgaggcggtacacccactcctgaggacagcccactgggcaacaagggtgcaaaggccttgcccacttgctgcaattgtgcataatctgaagagctatcctagttccagagttccttccagatgggactatcagtggctggggtggagcctctgcaacctctcctttagctgcttccaagggcccacctgtgtgcaaatcgccagcttccagaaacccaacctacagaggtgtggcctttaaaactcctgagacagactgactcaacctatcctccgtgagcaggcaggaagaggcgtgataattttaatttttaattaaaaagatgattttaaattaaaaaacactgtatcacacactgagaacgctggctcctttttcaataggtccagttagctcaaggagggtcttagctggtgtgatgtaagcagcctcaggctgaaaggctcaagtagttaagagtttctagatagaatgcggtaataccgtttggtttctactgcatttattttgacaattaccttctatttatagcactcattttctattttcaatgatgatgcaaatttctctttttaaataagttcactgaagttttgttaagtgaatcaattttttttttttttgagacggagtctcacactgttgcaggggctggtgtgcagtggcacaatctcgactcactgcaacctctgcctcccgggttcaaacgataagtgaatcaattttttaaagcattaaacaaataataatacaaagaatactcagatatagcaaaaattacaaacttagcgtgtgagctgaactgaagaacactggcttagcccttaggatggcctaaagcccacttctgcggctggcacagtcgtgaccttgagcttaacctttctctcagtttgcttgcatgtccagagggcaagtgagcttggggctcgattttttttttattttattttttgttttgttttgtttgttttcagacaatgtctcaccctgtcacccaggctggagtgcagcggcatgatctcaactcactgcagcctcaacctcttgggctcaagcaatcctcccacctcagcctctcaagtacctagaactacaggtgcacattaccatgcccggctaaggggctgaactatttctgatgcagagacagagcagtgaacatgacagagtccctgtcctcatgttgtttatattctagggagagacagacaataagcaaaaaggggcaaaagatccgatgtgtcaaagggtgatgcggactgttctgttgagaatgacagagtaggggaggggcgcggaagggcaggagtgcagcaacttaaacaggagggcatggaggcctttgcggagaagatggcatttccaaaaagctttcaaggcaagaagggagagagccgcagggatgtctgagggaactggtccagcagaggaagcggcctggggtgagaatgggcttgccatgttctggaacagcgaggagatccgtgtggctagagccaggggagcaagttccgaggaatgaacagggcctggcgggctgtggggattttattccaatgaggcaggaacctttggagggtgctgggagaggggttgaagagatctgattgatgtttccagcaggtctctctgttggctcaggggagaaccaatctccaaaatacttcatctctgtcaaagcctccgacattcatccttgtgcccgggcatcacagcagctttgtgaggctggaaggacgggagccctgctgaggtgcaggggggctcatgatagatcgcctggaatggggctcagtgatcccaggtctgggcaccctgcacaaagtcacactccagagaagcctgggaggtgccagaaagcgctggatcacgtgaacagatgcgcacattacccaagtgagaaacaattcctgagcacttattatgtgccaggttctaccaacgtcattcattctctcaaccaccctagaaggtgagttttgtgatacccactttacagatgagaaaactgaggcacagagaggtaaggtcattctcccaggatcccagagcaaggaagtagcagagctaggatgcaaagtcgagcagctgggctctaaaatgcttgatctcccaggcccagggaggatgccaggaaggccccagcacagaacaacttcccacaaaggcctaaacatccaccctccacacgtcatgactctgatggtaagtgcagccttcaccaggtgcctagtttgatgaggctacatgaggagggtcccaggtagcagaagagaggacacggaaaagaggttgcttcatgcacactgaactccccgtccccagccccccagccctccgctgcatctctgagcaagtcaggaatcctgcagaaagagagaggtgagaatagccccgctgtgtcctcagggtccagggctcctcactgacaagcgagttaaacccacttccccacagcctctggggctcagacagagaagccaaaggaatgaggggggccagggcttttggcaaactggacagtgcaccttgaggaccctttctcccacttttgctaagtataggcaatcctaagcaagctcggatcatgacatcacagccaaccccaagcccaccccctccaggaagcaggccggagtaacactcacagctgacacgcggcattagcttggtgctgagccaggtcattcatcctcatgacagccccctgcagcaggaattgtcgttacccccactttacagagttggagactgaggccctgagaggtgaaaggacttgcccaaggtcactgggctggcgagcagtagaacagggatttgaacgttggctgttggctccagagaaaaagcacttcctgtctcctctgaacccaaaggaaagactgtccctcccatccttttcattttcctattcaaacacctttactgcacactgtggccacttgccccttctcaccatctccactgctaccatgctggtccgaggcaccgtcatctcacttggtggggtaacctcttagatgtctcccggcttccagttctccctccacagctactccccctcacagcagccaaagggcctgtggaccacttccctcctctgctcaatgccctccgctagcacccagcccacctgcgccccattgtgctcttatttgtccaattccaaagatggaggagcgtccgctatgtgaataggaagataacgtcgacatttattgagcacttactgtgccaggagctgcactgagcaggctccttgtattatcttgcttaatcctcacaatgtcctggatttatcccgtttatgggtaaaaggacaatgaggcacagacaagatcagtcaacttgctgagaggaccacagttcatgagtggctcagcagcctggccagaagctctccttgccctcactttcacgtagagagtggctggcccttggctgaatgactgcatcttggggtagtctgcacgcctgatcgcacatgagacttgccccccattgccctctgagggcaaagtcacacagctccatcatcttaggctctagccactcagatgtgatcccttggagaagtgagttagtgatgatgatgatgatgatgatgatgatgatgatgatgatgatgagttaacagtggccgagtgctgatacaccaaagtttctccaccttggcaccactgacatttgaggtcagatgattctctgttgtcggggctgtcatgtgcattataggatgtttggtggcatccctggcctctacttactagaaaccagtagcactctagagctaggacaaccaaaaatgtgtctggacattgcccattgtcccctgggggccagaatcaccccagctgagaagctctgctctagactctctacccgattgctttacctctgagtctggccatcaaccttaggaggtatacggaattgtccctactttgcaattacaggaggaaatagaggctcagagaggcaaaggagtttggctcacatctcgtgcccgtgaggctagcttgggttcttctgtctgtgaggggggtcccaggtagtacagaaaaagagggtatggaaaagcagttgccttccttcttccagcctaccacccacaattccaaatgcgttagtaatcttgcaggaagagagaggctattgcaacaagcgtcagcctctctgaccaacagcccaacggggcaccccaggatcagacacccttactgtccagtgggtgcctgagccgggactcaaacccaggtctgtctgatgccaagtccatctcttcttggccactagctacctctgatggtcactgtggcagaggggccccgccaggccaggaggtcgcaggactccaggacacatgcattcagtgagggcccaccctctatgtggagctgagggaaaggagagtcactaaaaatgcccacagcctgctgggcctgacctacttcccatagttccagggatgcagactgggcccacctgcccaccttgctaccccatctcccagacaggcctacagaggaagctggtgaaggcggatggggcagggacccagggagaagcccacttttcaaaaactagagtccaccaggggcagtggcatggtactcacgaattttaagaaaacattcccaagttcatgctgagactgcggctccgggtgtaaacaatactccaaggcggccaagaaatccttatgaacttccaggatgtcttcgatgttcgagaacaggacctgtgaggaaaagagaggccagaggacagcgttaaggctcagagggagagcaaagccaagcactgaaaaaatacaaacctcggtgcgggtgacattgtagtcaaagaagaactctcaaacaccggaactggtttaccactaatagaaatctttgtaataacagaaatattaccaatatttatttactataatcggaattagtgactaatcgtgtgttaagaactttatacgcattcatagaatctaatccccactgtaaatctgtgagatagaaactattgttatgcccaatttacagatgaagaaccaaggctcagataaaataatattcccaaggtcaaagtcttgcaagcagctccacatttagtatgcagacattcatcacagtcagacacaactgctgtgtccagctacaggacgatgttgaaattacaagtatatttccatgcactcattaaaatgacgtggtagaagaaaacacaataaggaaggaggttagaaatacgctgtctaaactctcacaaacaatatatgagataccctgtttccccacatcaatctaaaagtgtaaaacactaatacaatttgacccagcaatcctacattttagaatttaaccttctgatcagttgttcccaacaaggggcaattttacccaccaccccgccacacacacaggatatgcggcaattgtcaagggacatttttggttgtcacaaattgggaggaaaaggggtgtttcgtagacagaggccagggatgctgttaacccttcctgcaatgtacaggacagaccccgcaatgagcaattattattattactttgcctctctgagtcttttatgattgtattttttaaattattattattattttcttttttagagacggaatctcgctctgtcgcccaggctggagtgtgaagtacagtggcacaaacttggctcagtgcaacctccgtctccagggttcaagcaattctcctgcctcagcctcccgagtagctgggaatacagatgcatgccgccatgcctggctaactttttttgtattttagtagagacagggtttcaccgtgttgcccaggctggtttcgaactcctgagctcaggcaatctgcctgcctcagcctcccaaagtgctaggattacaggcgtgagccacctcgcctggccctcatgattgtatgttttttaagaatagttgttaacagccaaaaactggaaataactaaaatatccatccacaggagaatgggtaagtaaactgtgttgcattcctacaatggaacaccacacagcaatgaaaaagagtgaaccacagctacacacaacatcatgggcaaatcccagaggcaggcagggacacgaaagagctcactttaatgtaaatttcaagaacaggcaaaaccaatccatggtactaggaaccagggattacctttagggagggaggactgactgaggggggcccagagtgggcagttggggctgggaaatgctctctgccttcatttggtttcatggtacactggtgcattcgtacgtagacacgcactgcattcagcactaaggtttgcaccctttactgtatgagacttctacctcattaaaaaaaaaggtaattttttataaactgtaataagtcgcagcttaaaattataataaataatttgtaaactataacaaacagtgtaataaataagtggaataaacaggaggtgctcagccatatttgctgaatgaatgagtgaataaatgaatgcaggcatagagtttagatcccagtgcatgaacacacacacacacacacacacacacacacacacacacacacacacacacacacacacacacacacacaccccacccccaggaggagccatgcagagaccttgagcaagtccttgacatctctaagactcagctttcttatgcaaataattcggtgtagagctgtcaacatgcaaggccaccgtccagattaatcagggcgtttggggggaatgtcttctatgaccgagtcctttgtgtgctgtaaatactgggcaccttggacaccaggaccctcagagccccgaggcctgaaaggcagctcagagagtgaggtcacacagaaagccaggcctggagagccaggctggggctgagccatgcacacagaaggcctattgatctcctcctcaaactccccagagccatggccaaggccaaactggacccaattactcatcagccctgcctggacactggatgcccagggcgggagcgggggccgggactgccaggagagggactggaggtgcccggctcccgggggcacttgggagaggattttccactggctccaagccagagggcctgacacgaggagcccggaagactggggggtcacaatgagcacagagggaaagtctcgggttggaaagtggggcccggggctaaaaattcctgctgacatccaccaagcacagcttgctcacaggacaagaggcctccaggggctgaagggagcaagctggggcagggcaaagctggcggccagcagccagcgggtgatgcgcctccccctgcatgcacaccctctgagcatcgcacgggaagagcaaggcacaaagcaacacagatgctctagaacaggggccagccccagcgtccacaccttgacattctcctccgtgaggcccttctccactgagtcggccacgttctgccggatgcgatgcaggaatgcctggaggagagaagcagagagaggtgagtgtccgcgtctccagctctcccatggacggccctacagaaggctctcaagttcaaatgccaactaggatctgggaggtaccacgagtccagggacacaggcagaggacgaggaaaaacgtgctctgcttacaccttaaacacactggagcagccctcactcccacacggtcaccaggggtgtgctgtgcacctacgacgccaggccctgcactgggccctgaagatacagcagagaaaatctcaaagcccctgccttcgaggaacctttggcccaaaaagatacacacctgcttcctcacccaggggcgcctctcagactctaattcatttcccctttcaattttttttttactttgctttacaatttaacctctgagtaataacacagtcacatggctcaaaagtcaaaaataaaaatggcaaaaacagagaaagtctctctccttaccccagccccaaaccatctagtccctccccaacccctacaggaaccccagctactagtttcttgggtattcttccaaaaaatctatgcaaaaacaaacacacacacatacacatctattcctttttttttttaacctctttacacaccaaaaaatagcaacgtatactggatgacccgcacctggattttctacttaatatagctcagagatccttccagatcatctcacaagaagcttccttgcagatgccaggaatgtactgtttgaatggaccatggtccttctaccaccctttcaggggcttggaacagacaaatcacgtctctcctctgtgagacgcagtagatgagtgtgacgacaccagggcaggagtgacaggggctgcgggagccgagggtgcaccattcatgtggggtcacgtggggaggccgcaggcccaggaccaccagaggttcggatttgggtgttgttgtggtttttaatgaagccagaaattagaattttttttcaaaagaaaagtctcccagttttgaagtgttggtgaaaaagccctctgttattgcaaggaactggattttaggggttgtgagtaaaagtggggggaccagggcagtagggtgcaatggtgccaacaagagatgacggtggcctggcaccaggtggtgtgggtagaaaagtggcagaaagaagagctgccgaggggtcacacgtatgggctgagagagtcacagggataaatgttggggaaaggagagacagcagagtcagcacctaagggagaccgaggcccagcacccacagccacctccgcctggtttgccggaactccaggatgtgggatctggctgtaggctaacctggaagcagccacatggagacccctgggaaaaggaattcatggtgctgtcatagccacagggccacggggagctgtggggcctatcagtcacctgccctgccaagatggatgacagattgggggtccacacgggggctgctccaggtgagcacatggtctccctgtcacagagcccaggtgcaggctgattaagacatgggctgcaggggcctgtctcatcccaccacgcttgtctagggagatctctgagtgcaggagagatggcggggacagcccaagatagtgctggggtcaggggaagcggagcaggtaagcagagaggaggctagccctctgcacaaggctgtcagatcctttccatcacccagagacacgacacgtccatgcctgcccccgggagcccggccacctgcccagactcaagcctcttgggagggggcgcaatgacagtccacatggcgagtcacagaggaaggcaagacacaggaagcagcttcgtctctgtccacacagagtgcagagccatctcagccagtcttggggctttaacccatttatgcctagtgttccattactggaatgctaagcttgtgggagttacttatatcctactcttcaaggtcattgccaaggtctgattttttattaaaaaaaaaaattgcaacctccagcataaatgggttaaatcccctttttttatgacccccatgtttatatccccagcctggacttctcccctgaaacccccagactcttatctccagctgcagattcagtgtctccacctggatgtccaaactcagcctgtccaacacttaattaatgacctttcccaaactcacaccgaactcttccccacttaatggcacctctgtctttcaagggctctagccaaaacccactagccgtcctcagcccctctcctctgacactccatttccaatacatcagcaaatgttaccagctttacctgaatactacaaccactggtccccatctccacagccaccacccccccagtccaagccatcatcatctcctgcctggactaacacagccatttccctcctggtccccttcaccctcccaaaagtctgttctctacacacacagccagggagatccctttaaatatgtacaggagatcagtcaatccatgcctttaaaatctccatggcttcccactgcacttaaaatccaaatctttccatggtccccatgatcttgtccttgttaatctctctgatctcatcttccagtacttcatcctcccacacacctcaatataaataatcttcagccacactctcattctagattctatccacctgccaaatacactcctgcctcaggacctttgcatatgctgttcctgcttgcaagatgttctcccccattctgccctgagcagcctcctcatccatccggccttagttcaaatgtcacctccgccaagaggccctcctcttcttaatgcaaactcctatcttcccatcttgcgttaggagctcatttgacagatgaggaaactgaggttaagcaatctatacaagctcctaagggaaaggccaggataagcagggatcatggctgggatgaaaccataacccccaatccaacatcagaggccaggtttggaaactggtgagtctgagtttcaaccatgggtccttcctgctgtgtgacctcaggaaagtgcactagcctctctaagtcttcatttactcttcccagtggaatcataggaatacagcaccttttagaatgtcatgggataaagtgaatggaagctccctgaaggcagggaccctgcctgtcttgttcacagctacgtcttcagggccaaatgtagtgctcagcaaatagcaggtgcttgaaaatcaaaggaaggtttggaatgcgcctggcacagtgcctgacccatgccggagacctcgactcaggctccttggaagtctgtggatcctgtttttgaaacgacaatgagcggaggggacagggactggggttcctagaggatgttttaacagggcctgggatactgacaggaagtcaagctccagcctccccagactagagggagacaaaggcagcctcacccagcacagccagggagggcaggaagctgggagtgccgcactccgctggcctagattggggcttcctgtcctggtttcttcacacgagctctgccaccgctattgtgctgcaacaatgggaggctcgggccacccactgaggaactgcaaacaagccggtgtgaaggccacaatgggcagctcgtgacccggaaagaatgggcagcagaggctctgggaccagccctcctgctgcccaaggcacgactggcttttccaggcagcacggcgtcccctgcactggcaggatggtgaaagggaccctccagggcgactcttcctttgtccaaggcttgacagctttgaaacactcaggtcaaaagcagctctcatctccgaagcctcccttagacacaatactgttctcaggatttccagggctgcctgagaaactcctccagcctcggaagctttgcccatgcctggaccacttgtcctcacatctgcccaagtcctcctcttcattttatgaatgtgatgatgaaatacgtcagggatacagaaaagaatagagagaaacaacaaacacccacaaactcatcactacccagctttggcaaatcttaatactacaccgaatttgcttgaaaccatttgcaaaaagaaattcaacaagtctaggggaggcacagactggaaacgggatgaggaggctcttgggggtgctggaaatgttctatatcttgatctgagcagtggagacacaggtcactgcatatgcaaagccccagcagtatgcactcgagattagttcagtttacccacagtaccatgcaaatatcaaacctccatgtattaagtagaaaaggcagaaaggaatcattacagagagaggtgagccactgggcaccttctctccctgcaaggtacttggagctggtgctcctcattcccacgcatgcctctgcccacttaccaagctgtgtgcatctataagcaagagagaatattgttttgcatgttcacaacatttttataagtagcatgctttcagcaacttgattttctcactcaacatcatgtcttccacatttacccatgttgatatgtacactgggcaacatctgctatccagaccccacccttaccccacaccacatcgagctgccagcacctgcatctcttggcctgaagaccccgctctcatgtgcagggcaggccagaggtgcggaagaagtaagactgcctgggagcagccctcagtgatggccagcaggacctggcatgaaaagacagatgaggaaactgaggcactcgatggacactatctccccgagtgccttgatggattcagctccggtggcccccatggtaacccgcttgatgacacacctttcttggctgccttctcctccctgcctcactcccccactctcctattgatgcttcctggggtgacctcccaagtatgctacttgcccttgaatcagtctcgggtcatgttctttggggaatccacaataagacagacctcaagttgttcatttcattgcttactagtcaaaatcacagcatgaagtaaccactgccatgctgcagacacttgtttcaaacatccttactgtaaacaatggcactcaggtgtaagttctttcagctgtatactctcgtcgactggggtatgggtatacaagttcctctaggtgatgcacatgtttcctcgagcccaggcgttcaagttcctctaaatgtatatccaggtcttctggggcataagagaaggaccagagagactgtttactcagctcccagcctgagtgtttccagggtccccagagctctagactgagcaggaagccacatcataattgattagtgatgtctgccatggatgtggcagggagagggttagaaggatgatgagtttgccatctccaacaagctcccacttaatggagataccaagagtatgagacactggtctgaggtcaaacagcaaactggtgacaaaacacagattagaaccaggtctcccgatgccaggccaggtctcacctgtcgccctaacctgagcccagtggttctcaacttgggggtgattttaccccctagaagacatgtgccaatgtctagagacattttgggttgtcacaactgaggacaggggtgctcctggcatctagtgtgtagaggccagggatgctgcgaaacaccctacagtgcacaggacaaccccacaaagacacagctgaccgcaaacaacagtgacaaggtcaagaaatccttgcctcagaaaaggctctaattaaaacctagaaaaaaatccaacctcttccaccgcccaaatactgtctaatgcgggctcttctcaccccactggctcagctgcaggtacactggtctcctttttgtttcttgaacacaccaggcccccagcatccaggccttcgcacgtgctgttctttgcctacagagcttttcccaagacattcaattggcaggagaggtccctcctctcacaggccacccctggacccatataagagaggatctcacccactacatagccacctgaaccctgttacccttcacagacgtctccgctattggctgtgctcttatcaattaagtatggataggtttgatcattcagtatcatctccctcactaaagtatcagctccctcagggcagaagtcaatttccttggccgtctacgcagcgcctgggacagaggctggcacacagcaggtgctcaagagagactggtatgtggagaaaggatgggagagacagggagaaactgagaacaggctccagaaagtaagctgatatcgagctgggagaggcaactagaataagaacacctttttaactcactaactacacctttaggcctcattatgtgcaggtgctgctctaggtgttttaatcctcaaactcgaggaggcaggcattgttattactatgtccattctacagaagagcctaaggcccagcgcagtaaagaccttatttaaagccacacggctggcaagtgaaggagctgggccttaaacccagacagtctccatcacgcgccatcagtgagtgactgtggacaatgaaccgcatcagcctttaaaacaggtagcagctgcccttaggggtgcccctggggagctgccatctgcctggaacccatggctgctgttgcctggggaggataaatctctccctggagataaaaaggacagaaagaggccttgaagtcactccctgagactgatgccggcaacctgatctgcttggggagggggcccgactgcccccaaggacacctctgccgtggctggggtgacctcaccagacatatggtgaaacttgagagggccagggtatgggctgggagcaaagggaagcgatgagtgggggtgggtggggggagctccagaacacagccaagacaaaagggggtgccctgaggaccccatccccaacatgatctgggtggcggggagtcggaagcacagtgtcatggaacagcaagggccttggaatctgagcgatgataataaaatcgctataacagcagaagggggcttacacagcctgctgcaagccgccccacacagcccagagtctggggagctccccaattgcccaatgaccccttcaaatgcccaaatcctatgctccatccatccaagttctgggtatttatcctacaggggaaaataaatctcatatgtggcatgaagctttaccttcaatatctgatttataattccatcactgggggtttagttaaataaattaccatccagctcaacaaggaatgatcatgctaaaaatagtttgcagaagtctatttaataacacggaaaaggactgttgatgtatccttaactaggaaaaaaaatcaagttacaaacaagtacataaaatataatctcactgttggttaaataaattctctctccctaggcatagaaaaatgaagtatggaaggaaatacccatactacaagaaactatgtaggaatgtggccaaaattactagctgtcccccaatatcattctctccttttcctttagaaacagaactccagatttaaaaataaggactgtatttcccagcatcccttgcagctaggtgtgggcatgcaactaagttcaggtcagtacagcatacatggcatattatgtacaacatcttggaagtatccttgtgggttgggggaggaatgggtagggattctcttctgctattcccttttcctactgattggattgcaaatgcgatgcctggaagtgaagcagacatcttataccatgaggtagaagccacgtgttggggaaaacagagcagcattcagtaggcacttatgttcctagtgatggtacagccaacatatccgccctgggtcacctataattacagaataaggaaataaactttcatcacatttaagacactgttatttgggttttatcacaagccactgaacctaatcctaactgacagaggggcattctaaagaatttccattttcttctttcttcatttatttccctttccagatttctacaatgaacatgctactttttaagcaaaagtcatttttaacataaatgcatgtttttatttttctggatgggaggggtactaaacacacaggctctctctcgcccaccccatcacctgccccaatcatcaggacccctggcttctgtcttctcctccttggatatgtgtatccctgtgcagggaaggcagtgcccgccagtggggaacagagcagcggcaaggcaaatatgagatggaaagatttaccttctgcagaagagcctctgagctgccgaccagccctccttctctgagtcaactctggaaacctggggacccccacaagctggcctggagcttccacagcctgggccagaacacaagaatgtccaccacccagagcccacaccactgcccaggctgattaaaaccctctccactctgttcccacctagcattccttcatcacgtccatgccaggggccagaaacagagagccactggctcagaaccaactgaggctttcccaaaagacccaaattttggatttgaaacatcctccccaaggattccaccgctgactcattcagtcacagacatactctgagaggactgggaagagatagcttttttttttttacaaagtcagacttactactcctttactcccatggcacatttacaaagtccatatatgtatctataactcatttcattatatagtccacagcacaaacatattgctttgaattgtatctttaacaggctaatttcttcctgaaagcatacaaagaacctacaactgaggcctcctgggaatataccaaggcaccatccaccccggggcctttgtacttgctgttccctttgcctggaagactctttctccagatatctgcagggccccaccctcaattcattcctgtattagtctgttctcacactgctaataaagatataccagagactgggtaatttataaagaggtttaattgactcacagttccacatggctgaggaggcctcacaatcaaggcagaaggcaaatgagaagtaaagttatgtcttacatggcggcaggcaagagagcttgtgtaggggaactcccctttataaaaccatcagatctcgtgagacttactcactatcacgagaacggcatgggaaagacccgcccccatgattcaattacctcccaccaggtccctcccatgacacatgggaattatgggagctacaattcaaggtgagatttgggtggggacacagccaaaccatatcaattcccctctagaatcaaatgccagttcttctgaggccttccccgactgctccatttgaaacagacacccattcccctgcacactgtatctcatcctcctccatcccccacagcactgccctccacctgcactgagctgtttcttcacttacagttcctgtgtcccctacaaagtcagtcccaggagggtggcagcttgtttgggcagtgtccacccactggacctagaaccgtgctggactggacacagagcagatgcccagtaacaaggggttcagcaggtgactgatggtcagcatgttcgtcctgcataacaatcccacaaggtgggctactgcatcccctttttaggaaagaggaaaacagggcatgaatcacacattaggctctggagtcggccaagcctcgcacctcagttgcctcatctataaaatctgtgtaatggagcctcaccttgcaagtcgctgacatgaggattaaatctgacactgcttgtaaataacttgttgcctctgcccacggtgggagcccccggcccccaggatccagccaggatcacaggaggtgcccaataagtcctcagtaaatgtccagtgaaggggtgggcactttcaattccgtgtagcccctggaccagctcagaccaggccccttccctgggcacatttccttggcaccattccttggacctatagaaatgttggaggcctttaaaaatacgtgcattggctccaaatacaaaaggaaaactgcattgtcaaaaagaataaatcttgatttaaatgtctacaaaattaccaatcaactctgcctgtggctatgtgcacagagaatgcagggagtgtgtgctgtgggtgcatcttagcgggtgtaccatgacaggacccttggggtggttccccagatgcagcagaccctgaggcaagaagtggagtacaagtagtttctttgggaggtgggaggtgggagatggtccctggaaacaccaacagggaggtggaaccaagaagggaaggcagcccacgaagggtatgagaccaagcaagttaccaccatgaggccccagacagaccgtgtggaacgcacacctcacagccaccctcagggagtgaggaggccagggagtctgtacatcagccctgtctgtcactagtttaagggcagtgggggtgatcctggcactccccatcttccctgaaagtgacagagcagctcagagcagacaaagccatcaggcagaggagcgcaggtgctggcagtggagcgtccctctggtgtgccctggagtggttgaggtgtcgcaatgcagcctcaaaaagaaagagggtgtagggcccccccgagcttgggggggtgaaagacagggctttgcagcaccgcagccacacaggccaggcacttcagcagatgttctcctaatacacaccaggacggcctcgctgcctgttaaaacaccaaaatacttctgagctgatggggaaaatctctacatgtgcagggctgaaggtcagaggaggtggctgcggaaccacaggcagtccccggtcagacgtggaggcaggtttcacgtggagcagacacagggagcaaacagcattgcgtgtatctgaggatacagcatcacgggcagggtcaacagctggggcaaaggccccaaggcacattcagtctttccaagacaatcctatcgaaaacgcctatccctgctctgttttcctcacagcacctgtcaccatggacattatgtgtgttcattatcagtctattatccatctagcccacctgaatccaggctgcatctgcggggaacccatacacattcccctgcggaggccaaagatatggccagcattccacctcctcctcccatgccccaactctcagaagccctccctacccttagaaactctctctactccttgctagaagggcactgtatctcctaagcaagcagtatgtaagagtggatgaggctcaaaggctagaactagccacctggttcaaatcctgcccctgccacctactgctctgtgacctaggcaactgactccatctctctgggcctcatctataacatggatggggaccataaaactactgacttcatgggctattgtgaggctgatatgaaatactgcaggcaggccaggcgcggtagctcacgcctataataccagcactttgggaggctgagatgggtggatcacctgaggtcaggagttcgcgaccagcctgaccaacatagtgaaaccctgtctctacaaaaaatacaaaaattagccagccatggtggctcacatctgtaatcccagctacttgcgaggctaagacaggagaatcatttgaacctgggaagcagaggttacaatgaactgaaatcgcaccactgcactccagcctgggtaacagagcaagattccatctcaaaaaaaaaaaaaaaaaaagaaaagaaagaaaaaaagaaatactacaggcaaagcatttaaatgggctcaaatcccagctctgctgcttacaagctctaagacctgaagtaaattatttattctctctgcctccatttcctcctctataacgggggataaaatgagtacacaggattacaatgagaattacagaagctaacacacataacaagcacttgaatggtccctggtgcatagcaggtgctcaaaaaacattagctattattggccaggctcacacctgtgagctcacacctgtaatcctaacactgtgggaggccgaggcaggctgattgcttgaacccaggagttcgagcaatcaatcaatacggcaaaacctcatctctaccaaaaatacaaacaaacaaacaaaatagccaggtgtggtggcgcacacctgtagtcccagctactcgagaggctgaggtgagagcatcacttcagcctaggaggcagaggttgcagtgagccaagatcgcaccactgcacttcagcctggatgacaaagcaagaccctgcctcaaaaaaaaaaaagcattggctattatgatctccccatcttgagtttctagagtgtctgcagggagtccaagccctggtgcaggtagacagaacccactgtgcttcctaaggaaacctggatttggatcaaccacatctgtagggcttctacatgcaccaagcacactcacatttatcccacactatttttacttatttttattagttttttccatcctgcaaatagctctattattatagactgcctgcttccgagtctcctgaggtgagatgagaaggggaaggctttataaactgcagagccccccacatcctcatcaccaccagcgcacccctctgccctgccccatcctccttgctgactgccaaccacgtgacttcagcaagtcaccacacttctgagtcaatttcctggaccaaacaaaaagggggggaggagtagttgttgaggtttaagtgaaatgatgcaggtgaacactttgtaactacaaacacttcctggaaaaagtggcagaaaggctgagccaggagagggaggctggactaggaaaggggcaggaagttgcttgtgatgatattctagggggacaagtcctctccgagtaccaaccatcccagcaagtgttaaccagggcctgccgtgcaccaggcaccgagctgggtgctggagacacagatataagccatgaccctgccacggaaggacttatgcattcttacattcgcctgtgtagtcagcaaatacttactgcacacctattatgtgccaggcactgcgctaagagccaatgacacatcagtgaatgaacaaatcagactaactccccaccttcacaaagtagtggcagagacagactatacactgattttaaaataaaatggcaggtaggaatgattgctacaaagaaaactaaagcagggtaagaaaacagagaaggataaggtgggaatgccatttcaaggagctgttcagagaaagccgttctgagaagatggcatttgagcagacacagggagcaaacagcattgcgtgtatcggaggacacagcatcatgggcagggtcaacagccggggcaaaggccccgaggcacattcagtctttccaggacaatcctatcgaaaacgtctatccctgctctgttttcctcacagcacctgtcaccatggacattatgtgtgtttatatcagtctattatccatctagcccacttgagtctcacctccaggaaggcaaggatgtttgtctgtctaggtcactgtggtgtcccagagcctaggattggacccagcacacagcagaccctcgaaaaggatgtgtttaattaattagtcaatcaatcatctagagtagactactcccacccccacccagattctaggccctggtaaaaggtgcccagttctcaccccaccccgccccgttccccaccacatcgggagaggaagttgatgcaaaaaacaagttgcaacaacctgtcatgaagaggtctgatgcaacagtgggggaaggcagtgggggacactgagaggaacccaatgcttttcttcacgcagcccccatcaaggggctggggcctggcctacaaactttcctgagttcaccaacaacccatccttccttcaacagatatttatgcagagcctcctctacatgatggggctaccttatgggtctcaaactggtaactcagaggcatcattcctttggcctgcagaggggtttgagaaacttgggcctaagtttgaatatcaggtttcccattaaaatccaaattccaagcttcttttgaaaaaactgacacatgggtctcaaatgcccacaaggctgcaggtgctgtagagcagagtgatagccatcaccttcacccaggacaagtgctcctcaatttcccaccacccaacccactgctgcgccctgtgaacacctgagtgtgagacttctgtcctagacacaggcaaggcaaacctgaacctgctacttcgcctttaccctcacccagggcagacatcactaatggaatgcagatctttttcctgctaagtcttctccaagccgttcagaatttatctcccttcactgttgtcagaaatggtctaaaatccttcccattcacaacccagcttctccctactcctttgggctcctcagttgttgatttttttcctgaaaaatgggctcatcagagtgggattctagcagagattctcaactttggtaccttgacagttcagtggatagttctttgctgtgagggatgtcctgagtattataagacactcagcagcttccctgccctctaccctctagatacaaataacaaccctcctctcctcagttgtgacaatcaaaaatgtgtccagacattgcccatgtcccctggaggcaaaatcatccttggttaagaaccattgcattatagcaaagctaagaaaatggcctctagacagagccaagtattttgggttcaaatcctggttcggtcatttgctggctgtgtgaccctaaacagcctctctgtgtctcagcttccctctctatgaaatggggatataaaaatggtacctgactgctaatggtatgaagtttctttttttttttttttttttgagacaaagtctcgctctgtcacccaggctggagtgcagtggcaccatctcagctcactgcaacctccgccttctgggttcaagcgattcttctgcctcaacctcccaagtagctgggattacaggtgcatgcctccacacctggctaatgtttgtatttttagtagagacagggtttcactatgttggccatgctggtctcaaactacggacctcaggtgatgcacctgccttggcctcccaaagttctgggattacaggcgtaagccatcatgcccagccaatatgaagtttctttctgaagtgatgaaatggtcctaaaattagatggtggtacaactctatgaatataccgaaaaccattcacctgtacacttcaaatgggtaaactgtatggtggtacgtgaattatatctcacactattacaccaaaagaagaaaaaagaaatagatacctgcatcacgggggcatggggagaatttgatgggttaggataaaatgcactaggaagcactgtacgaactgtagcccttatcgtcagcaccagccctcgcccatctggggcctgcatgggcgtgtggctggaaggaaaagcctcaagtgacggagacagtggtggctgggaacaggccctgctttgggtggcatttcccgccggaatgtcctggacaaagagaaccaagtcactcggggccccaggatgcagggcggggtggctggacatcctggggtccttgtgcctgtctgcagcaggacaatgagtggaatgcggtctcctctctgtggggctgacacttgacatctgaagacaatgactttcaagaggttttgttttttcctcagtccaactattttttttccatcttcccaaacaattgttcctggggctggagggcgagcagtccccccttagctggtgaaggattgtatttgtagagtcaggaaacaatgcacaaaagtgagagaatgtaaaaatagtggcattcagggcccaggcctcagtgagggaggtgcagccatggaggtttcctcccattgatttttcccagagcctgctcggccccagggagggaattctggcagcagaagggccagtcttaggagtacagacactggctgcttggctgcagcttggggtcttcagtttagggagtgtcaactatgtacccaatgcttcccacgattgcctcatcctagacaatctcatctccattttacgaaaaaggagaccgaggttctcagtggctgacgcggcagcctcagagcatgcagctaagcagacaaagctggcctctgacctcggggccatcagagtccaggctctgactttctgccacatccactctaaccctctcttgcgatctcagcttccctgaccagccactcacttcccactagtgatggggccacatcattaaagttgtgacccccaagctccacaagggaagaaacttctgtccctggagcccaatacagtgccaggccttctgatccaacgtgaaaggagggagaacttgcaggacagaaaggacccagagcttgcagacatcagaggactctcagagaggccccaacagcccttgaccattgtggtgggctgaacaataatccctcaaagacgtccacatactaatccacggaacctgtgaatacaccaccttccatggcaaaagggactctgcagatgtgattaaggtaaggatcttggaaagggggggattatcaatagcattgaggtgggcccaacataatcacaaggatccttaaaaggaaaagaggggctaggcacgatggctgaagcctataatcccagcactttgggaggccgaggtgggtggatcacttgaggtcaggattttgagaccagcctggccaacataccaaaacccaatctctagtaaaaattaaaaaattagccagatgtggtggtgcacacctgtggtcccagctcttggaaggctgaggcgtgagaattgcttgaacacgggaagcagtggttgcagtgagccaagatagcgccactacactccaacctgggagacagagcaagactctttctcaaaaaaaaaaaaaaaagaaagaaagaaagaaaaagagggaggtaggagagtgagtgccaggggtcagaggaagaccagaagacgctatgctgctggctgggagatggacgaggccacaagccaaggaatgcaggggcctctggaagctggaaaaggcaaggaaacggattctccccagaccccccaggagcacagccctgctggcaccttgatttcagccccgtaagacccagttcagactcctgacctccagaagtgtaagataataaatctgtgctgtttaaaggcacaagaaactaatacgactgctagctcgaaacatgtacacgaaagaaaagcaaacctgttgtatctccatgaatcacggccaaacacaatcctaatactctgttattatgattactacaaaacagatattatcatacagtctagctatacatttcatacattgtttggcatatgtttagtaagctgcaaaatgctttctttccccacccacaaaagtatctacaaacaaatattcattaaggacagatggtctaataacagtaattactataataattacagcaacatcaagtatctttcactattcagatctattcagttcctgagtttagaaagcaagaagccatttagaaagatcagataagggaaaccttgggatactaagctgtcagaactagataatgcctgcatttccaatgaaacgtggacacgacaaccagctgcaacacatattaagtgcttactgcatgccaatgccaggggtacaggaggaagcgactcctacacccccatttcacagacaaggaacagagttatttgctcaaagtcatgcagaggaggaggacggagccagacctaagtgcaggccccaggggcttcagagccaagtctctttcccatggggctatactgcttcttcagttcaaaaattgggagaatttaattaggggaaggagaatagtgtagcctcgtgggaagaccaggagttgggaggcctaaatcagcgtccccaatccctgggccgtgggctgttaggaaccgggccacacagcaggaggtgagcagcaggcaagaagcaaagcttcatctgtatttagagccatccccattgcccgcatgaccacctgagctccgcctcctgtcacatcagcagcagcatcagattctcataggagcacaaaccctactgcaaaccacccatgccggggatctaggttgcaccctccttacgagaatctaatgcctgatgatctgtcactgtctcccatcacccccagatgggactgtctagttgcaggaaaacaagctcagggttcccactgattctacattatggtgagttgcataattatttcattatatgttacaatgtaataataatagaaacaaagtatacaacaaatgtaatgtgtttgaatcatcctgaaaccatcccttccccacccctaggtccgtggaaaaaaatgtcttccaggaaacccgtccctggtgccaaaacggctggggaccactggcctagatcacttaggcatccctgggtggagtgacacaaagggatcgtcacaaaaggcaaatgtggtcacccactgccctgcccagcccatcagccgctccccgcttctctgagaaccccatccagaagggctctgcaggacctgacctcagcctccaagctgtgctgcagccagaccggcctccaggatcctcagctgttccccaaacacacccagcttgctcctgcccccaggcctcagcacaggtgctccctccacctgcaacactcatctccctcctgccagctgcttcaagtctcacattccctgccctccccagtgagatccaaggttggtcagggcccaggaaacccatgcataggctcccatacttagtgccaccatgactataacttaaccttgatttatgtgatgattcaattaataacaggcttgcccaccagcctaagacctctcagaggtcccacttagtcccagtttccatcttctttcatttatgctcattcttggtgagtgagtggatggacgggtagagggagggagacccctttctctggggcaggttcctcacctgtaaaatagacactgtgtgataacactgccggcttcatggattaccatgaggactacgagaaatgctgcacactagctgaatgatttcagatgactgattcctcctctctgggcctcagtttccccatctgcacagcgcccaccactcagggcctgctgacctggttgccaaatgtagccctgccacagactcgctgtgggaccctgagaaagctgctcccacactctgttccctcgtccgcgaaacggggaacagtggtcagatgagaggatctcaaagggctcccagctctggggctatgaggtcaggcccacacattctaaccacctcgactccctgccttccagccagaccagtgacaaccagccacaccacagactacgacagctcaccagggattctgcaagggagtctttcaatggctccttccctgggggacctgactatgggacagagcccccgaggagggaggggagatgatggaaccagagaagcatgaagaagccccctcaaacgagggccctgaagaggggatggctgagagctggaagatggaggttctggtgtcagacaagctggttcaagtccccacctgtcagcgggggagggtacgtgggcctctgaacctcagtttccacctaactcagagaaggaaatagataacgaaccctaacttcagagtcgcaccagagtgaaatgccaacgcttacgttaccatcactgatggggttcttatctgtcagtgcatcgacgtaaaagcagccctctccaactacagaccacgctgtactttcccgacatttccccagagtcgtgtgtctcattccactgcagccccaatgcctagtctgcccttcctaggtcaccccaggctttttcttacctcagggactttgcacgtgctgttccccgcccctcatcgtcactgcacaggatgctcaaatatcacctccacagagagcctcccctgaccatcctggctgaagcagcctcacccaagccacaagtcgcccccgagccaccctctacctcgataatctgttttaattccctgtaatgcaggtagcacaaagtgttgttctatgcattttgctaatttagagtcctcctctctgcgcactgccagctccgtgatggtgagggtctctggctgcttgtgctgaatccacagcatgggttgaggtagacagaagatgctgaataaatactggttaagaggggaaaggaggtgaagttccataagcctccaagcttccattcctatgtatgtaacacagagtaaaagcctctatctctcagtgttcttttgaggattcaaggaaatatcactcaaaacataaagtgcttagcacagagaatggaacacaataaaaactcaaattttaaaattaccaatgtccatcaacaggagaacggatgaacaaatggtggtgttctcacacaacagaaaatgattcagtaatcaaaagaaaattgctaacacacgcagcaaactggacgcatctcaaaaacatggcccaagcgaaagaagccagacacaaaagggtgcagccacccgtgggattccacatctacgaagtcccaaaactggcaagacccttctttgatgacagaggttagaaaagccgtcactcggccgggcccagtggctcacgcctgtaataccagcactttgggaggcagaggcggccgatcacttgagttcaggagttcgagaccagcctggccaacacgatgaaaccccgtctctgctaaaaatataaaaattagccaggcatggtggctactcaggagactgaggcaggagaatcatttgaacccaggagacagaggttgcagtgagctgagatcatgccactgcactccagcctgggtgacaaagcgagactctgcctcaaaaaaaaaaaagaaaagtcgtcattcaaggctggataaagactggcaaggggctcaaggggactctggaggcaaagaatgttctagatcttcacctggtggtgatgcatacgtaatcaccaatggagctgtgcacttcactgtctgtaattatcctgcaacagaaactattcccttttttttttttcagcaaagggtttaaaaggagattgtcaccgtccaccctggtttgtctactgtccacgcatgggttgtcctggctcaagccctgagggccaatacatcgttctggcttcaggcagagccagaccccattcccattccttctacaactgtgcatccacgaagccctggcttctttgaggcccgttgccaaagagacgagccaccctccacacacaccccctcgctgcctcccaaccctgcttctaagaagattcgggaacaggaagcctgtgtctgctctcaggttctgaagcaaagaggctgggggtggtggtgcgggggaggggagatgaggggctgccccgttgaatgagacgtgccttgaatcctgaggggatcctctccaggtgtgtgagaggtgtcccccgcccaccacaggcacagggacagccacaaacacctactctaccgtcgtcgctggggcatctctaggagccccagcacccactaggcatggggccggcttcgtacatcaaagagcccttgcatgttgcctttctgcttaaaatcctccaacagaggctgcgctatcagaatgagctcacactctgtgacctcacctcctacgcaactcccttctccctcatctcctcccacactggcacccttgaaggtgcagaaacacatgagacaggctcttgccacaggacctttgcactggctgtcccctctgcctggaacgcctgtcaccacgtaaccacatgactcattcactctgctccttcaggtctctgctcaaacgtcacctcctcagtgaagcctgccctgcccacaccattgaaaactgccacatcttcccagcagcccagccctctaattttgcttcatgtttttccatagcacttaccacctgagaacactacaaattttccttggctgacaccttcactgtctgtcttcactgcacacacggtgagggagagagcttttgtctgtattgtgcactgcggcagcctggacactcagtacacagcaggtgctccataaatcacttgtaagcccaaggaggtaaatttgaggtttatcacggaatggactttctaaaattttctgcaggatttcaattgtctgctaagaatatgtgctatctttaccaattaaaaagaacaattagaaatctggttttaaaagccaggtgggagccatctctaggtcagtgggtctgatgcccaggaagcgggcataagaattacctgtcaagcttttcaaaacacatgttttgcccaggaggtataccaggaaatgacagtctgactcaagaggtctggaaaagccaggaaatcagctctttttccaaagctcccagataaccctgaagggctccaggaggtacacgaacccgagaatgggcagcagggcagggaaagcagctcagaggaggtcagggaggaccctgagcatgaccttgacaaacaggcaagatctggccagccaggcacagtggctcacatctgtaatcccagcactttggaaggctgaggcaggtggatcacctgaggtcaggagttcgagaccagcctggccaacaaggcaaaaccccatctctactaaaaataaaaaattagccagacatggtggtgcatgcctgtaatcccagctacttgggaggcagaggcaggagaatcacttaaacctgggatgcagaggttgcagtgagccaagattgctccactgcattccagcctgggtgacaaagtgaatctccatctcaaaaaaaaaaatctggccatgcagaagtgaggaaggaaaggaaactggagacccagatttgcaaacctttgcaatcacaaggcaaccccttggcagccctaatccatgaccctcaggctacagcaggcgtctgaatcacctggggcactcagtggaaatgctgattcctgggccctgaagactgagaggctccaacgcagtgggagagggaggagcctgggcatctgccttgttaacatgcttccccaggcacctgcgatggggcaccaggtttagaaggtgctggttgagtcttctggtttcagtatgtacagttgcctttcatcaggaaaattaataaagtcataggaagaaaactggaaatcacacattctgacagtgcccactgtcaatatttcaacatgtcaccttccatggcgtctcctgcagtttttaggcatggctgtcatcaccggttgcacataattttgcatgtcacctttccagtggtccacagtggctaaggaaatgggtgtggctcatgtccctaaccatttccctatccgacctttaggttgttgccgattttgagcgctcacagtggtgtttcaatgagtaacctggtacataaaagtatctggggattttccccccatgcttaggatttttttcagcagtgggatcccctgcaattccaggggaatcactgtttgggagtctcttgttgtctccgctaagtgttttgccaaagggtttgcaccaatttattgctctaaaatgatgccaaaggcaacaagttctagccgggcgtggtggctcacgcctgtaatcccaacactttgggaggccgaggcaggtgaatggcttgaacccaggaggcagaagttacagtgagctgagactgtgccattacactccagcctgggcgacaggagcaaaactccatctcaaaataaaaaaaggcaacaaaagttcaagccttatcagccgtgcagccccatcaccatgcggaggaggaacccgaggcccagctgatgctcattaagaattccttcatgccggacacggttccaagtgctttctcaacagaaacccataaatcctcaccacagccctgtgggcagggtgtgatgccacgcactagcatagaagaagcattcagcaagcgtgttttgctattattattacttgcatttgattttcctctaaaaatgatgtgtctaggctgggcgcggtggctcccatctataatcccagcactttgagaggctgaggtgggcgaatcacctgagttcaggagttcgagaccaccctggccaacatggtgaaatcccatctctactaaaaatacaaaaattagctaggcgtggtggcgggcacctgtagtcccagctactcaggaagctgaggcaagagaatcgctcgaacctgggaggcggaggttgctgtgagctgagatcgagccactgcactccggcctggctgaacagagcgagactctgtctcaaaataaataaataaataaaataactaaaaaaataaaaaagtaaaaataatgtgtccagccatatcactgagcaaaactggggttccagaaagctgggccaggtttcttgggtggcacaggtatggccctgcagggtgcccatgcccccaagaaggcgcaggtgcgcagctcgtggcagccctgtttctggtgaatcaggccggcccctgtccctgtgacactgggtgagacgtgcccatggccatacctgcagaagagatgccccagcccaagcagtgccataggaggacagcactccaatgccccaaatactgccccagccaccaaccacgggacacagacccagcagttccctttttctctttgcggaacttcccaccacatcaagctggaaaggaagtcggcagctcagcgggaggaaaggcgacagtatacaaatcgcttcatgtctgctgaggaaatttactgccctgaaactgagggctgaggaaggaggaaggggcagagcaggctgggctaggactcaccctgtccactgccgtccagccaggatggccgcatggctgagtgccaaggccaatggcgaagttgtctggagaaatcaaaacaagtgtactcagggaccacatatccctgggcaggtcactacgttcgccgacctcagttttactcatctgtaaaatgggcaaaacaggatccacaacaagagctactaaaaagatttaagtaagagaggacctgtaaagtgcttaccagcacacagtaggtgctcaagaaatgtccataactggccaggcgcggtggctcatgcctgtaatcccagcactttaggaggccgagggaggcaaatcacctgaggtcaggagttcaagaccagcctcgccaacatggcaaaacctcgtctctactaaaaatacaaaaattatctgggtgaggtggcaggtgtcggtaatctctgctactcgggaggctgaggcaggagaatcacttgaacctaggaggcaaaggttgtagtgagccgagatcacgccactgcactccagcctgagtgatagagtgagacttggtctcaaaaaaaaaaaaaaaaaaaaaaaaggaaagaaaaaggaatgtccataccaattattaagttcaagcttctcatcctggcatctagctaccacatcctaccagaggcacctctggcctccaagtgccccacactagcccctttcctgatcaccgctaagcatgtgatgcaccagcaatgcaccaaccacagagcagcaaggaactgtctcaggacagaacctctgggacctcattcattcattcagcaggtacttactgagaagcagatgagctgagactgacatgaagaggtggggacatgtggctatctaggggagactgttccagacagcaggaataccacctgcagaggaactgaggcaggagtgagcccggtgtgttcaaagaacagcaaggaaagctgagagagggcgaggtgagagcaggaagaaacgaggcaagagacttaaccaggagccagaatgtgcagtgccttctgggccacagtggggtcttcagcttttctctgggtaaggtgggagccatggagggttctgagcaggggaaggacaggatctgacctgagttcttaaggggccatctggctgtgtgtgaacaacagactgtagcagggagctcaggaggagtctcctgcaatcgtccaggcgggaggtgatggaggatttgaccagggtggtggtgagctgtggtcagaatccagaggtattccaagacagagcccacgggattttctgagagatgggatgtgagggacgagagagagggaagtcgaggccgtctccctggtttctggcctgtaccactggcaaggatgaaggccacttttattgagacaggaagactgtggtttggggggcgggtagagagttcaatctcggacattttaagtctgacctcacgcaaggcagtctggtgaaggagacagaccgtccgtcagcaaatccttgcacaatgtgcattcaactgcaatcgtgctgagtgctgggcagggtgacctaggcagaggcattcagtgaaggctgcctggaggaggacaccagagcggaggcctgaaggctgaggagctggggacacacgagggaggggttgaaagctgctatctctgtgtgtcttccactttcctcatcacttcacctcccacttcacatccagtgaggacagagcccgagaatgaaggaagtgtggtttctggggttcagagctctggggtcagacagagatagcttcaaatcccagacctacccttttcttgttgcatggcctgaagctggtgccttcaccactccctgcctcagtttctacattcataaaagagggtgattctgccatgttttcagggtgtgtcaggctctggaaacccagataaagatgcccacctctctcccccaacctgggcacctccttccagcctcagtgagaagctgctttgccagggaagctggaaggatgtgacagggcagggagtggctggacccgcacggctgaaaccactggctgaggccacagatccaggcaaatctccggcccctccgctgccctggccaggcacatggtggcccacagagattttccatcaggtcaaaacaggaactccatggaaacgcacagcctcagcctgccatggggcaaggtgtttttccacagagcgaggctgaattcagcgttaaatggctctgcagggtggcaggggccactaccctccgaaaagagaagcaggtactagccagtgggagacaggaacctgcttccagcctcagctttggggaaacaggcacctataccacacccttgctcacacggtttccaccaccgcacacgctgctcctgcatccctgaccacaccaggcactcattggttctctcggcaaatgacgcatgtagcacgtccagaaggacaggcactgctgtaggccctggggatgagcatgaacaaaagagatgaagctcctgccctcacggagctgatattctacaggggtggagctggagccagggagattcaccagaatagactgcgaagccttacgaagaaatcaagcaggaaagggagagataaagcaaggagacgggtgcttttttaaatgtggtggccaggaaaagcctccctgataagaacacgtccagctgagacccagatgaggtaaggaggtaagccatgggttaccaagggagagcacaccatgggcagtggggcagcaggggcctgcttggtgcacagggacaacaaggagaccacaatggctggagcagagtgaacaggtgagagtaaggactgggaaaggggactcaggcagggggtgatatggtttggctgtgtccccacccaaatctcatcttgagttcccacatgttatgggagggatgcaatgggaggtaattaaatgggggcaggtctttcccgtgctgttctcgtgatagtgaataagtctcaagagatcagatggctttataaggtgcggtttccctgcacaagctctctctttgcctgccgccatccatgtaaaatgtgacttgctcctccttgccttccaccacgattttaaggcctctccaggtgtgtggaactgtaagtccattaaacctcttgcttttgtaaattgcccagtgtcgggtatgtctttatcagcagtatgaaaatggactaatacaggcggttttggaaatctgggcaagaaggtaggtgggggccagaggtgcagctaaggagacagggttctgttgtaagctcagcaggcaaggccctgaggaaggagggctctcacatctaacaagcagggggaagagacaagcatcacatcctcaccaatggaggtgagcacagtgacctttcccctggacggtagaggaccccaaggcccagctggagactcccctcaccccctgaggcttattttccccctctgtaaaatggggacacaagtcctgcccagcctcctgcaggggcatctaatgaggaatgaggctaaaagagtgaagctagagtccgggtcatcctggaccacaacctcagggctgctctggcccctacaccccaacagcctcccaggttctaaagtccaatgtcccccatggaccccgcccccctcagacagccgagacaggcgctctgagagccaagatgtccaaggaggtggcacctggcaaccagatgcctgcttagcagctgtgggaggggatggcagctggactccttggcaaccagccgctggagcctggaagccaggcatcacttcagagggggagtccacggggcggggctggggacagagtttctcaggctcctttctaaagcacatgactcacaggccctcggaaaacccagcaggcccctgaattccagaacactgcttgtagggctggaggcctctactttgctctctgcctggaaactacttagtgtccagtcactgaggtatttgctcccatggccactcagtctcctctctggaagggagaccaatgcctactatgcgggcacacgtgaagattcagcattaacacaaaaaatcagaacagcaggcattcaggaagcagctaccctgtgccaggctctgtgctacgtatttctcctaagagtcagtggtagtactgttaatcccattttacagatgagaaaactgaggcacactcacaggtaaagcatcacacacagcgagtggcagagccagagactgacctccactccaggcccataaccactccaacaccctgcgatgtgcgaaaggtccgaggggtttctcccgccccttggtccagtcaacaagtaattccactcatcaatatgaataataatagttgctgttgtttattggcaactatttagcaactgggaagtgagctaacgtttatgagcaacggggaagtgaggtaagtggcccacaaaggcacactgggaagggggaagtacagcctaaatacaggctttctgatgccaaaacccgccacaccacacgaggcacaaacaccagaccaggtctgaacaacatgagctggtcatgccccaattctctaactctccagcctccagcatgaggcccaggagcccccggccacacaccaccattctcttgagggtatgaaggctttcgctggaatcccaaacccagacagtgaacggaaggctgttcaaccccagcaaccttcagaactgaccattacggttgatgctgatcccatgcctaccacccagaagtgcctacagacagggcctccggcggaatccaaggctccctaacatcacatcacaaatatctgagaacaaaacttgacagctagagtcaggcagggaggtaagaacctgaaatgctgttgccctcaagaggttaacagtctcaaggtagccacaaccacacataatggactctgatataaagaccaaggcctgaagggtcacggcaaagccaagctgtatggcttggggccggcagctgtacctctctgagactctgcatccacatctgtaaaatgggcataacgacagcagtactctgtagtgacaaagacctgcggagaggctgtggatcaagaactaagaacaatgccaaaaacacagctctgactggaagtggggttgctatcatcatcatcagcagcagcagcatcattatcgggattatcagtatttcagatcccacagccagaggtgcccaagacgtctacaccaggggctacaaacaccaatgccaacagaagccatgcaaggaaagtgactgagtgaagctggccaggagtagtacaaaagggaagggtggggactgtggcaaactggagagcagacatccatctaaagggtaagctgtgactgtgttccaatcaaatgtcgccaggcaaaagtacagccggatttctgtttccctacagaaattggaaagccatatttttgcaaaaaaaagtcctacttttaaaaccctgtgctacttaattctaatatgttcatggtaaggcaaagaaactagaatagccaaaacaattctgtaaaagaacagtgttggaggattcacattatccagttttaagaattattatggccaggcacagtggctcatgcctgtaatcccagcactttgggaggccaaggcgggcagatcacttgaggtgaggagttcaagatcagcctggccaaaaggatgaaatcccgtctctactaaaagtcaaaaatcaaaaaaaaaaaaaaaaaattagccaggcatggcacacgcctgtaatcctagctactccagaggctgaggtgggacaatcgcttgaacccaggaggtggaggttgcagtgagccaagatggtgccactgtactccagcctgggtgacagagtgagactccgtctctaaaaaaaaaaaggaactattataaagttacaataattatgatgatatggtactggtgaaaggggagacacacagatcaatggaacagaaaagagagtacaggaattgacccacacaaatatggccgtttgacttttcataaggatgcaaaggcaattccgtagagaaaggacagtcttttaaactgttgctttaaaccaatgatcttggaacaaccacacacgatatgcaaattaatgaacctcaacctaaactacacacttcatacaaaagtaaactcaaaatggatcacagatctaaattcaaaacataaaactttagaagaaaacaggagaaaatccttgtgacctgagattaagaaaagagttcttagatgtgacattaaaaaaagcaagatccgtaaaagaagaaaagggataaattagaacaaaaatgaaaacttttgccatgcaaaatacactgtcaagagaacaaaagacaagctacagatggggagaaaatatttacaaatgacatatctgacaaaggatttatattcagaatacaaccctaaattaacaaaggaaacaagccaaaatttttaatggattaaaaaacttgaacattttcttcacccaagaagtatataaatggtaaatatgcacatgaaaagataggcagcatcattagcgattaggagaatgtaagttaaaattacaatgggatacctctatgcttctacttaaacggcttttgaaaaacccgacaataccaagtgctgatgaggatgtggaaccacagaatctctcctatactgctgtggggaaagtaaattagtacagcatctttggaaaacttcccacaaagttttttggcagcttcccataaagtcaaatatctacttaccatatggcccaacaaccctgctcctggatgtttaccctagagaaatgaaaacttatgttcacacaaaaagctatacataaatatttatagcagctctattaaaaatcaccaaaaactggaaacaagcaattcaacatgtgaatggataaacaaactgtggtatatccaaacaagggagtactactcggtaatgaaaaggaacaaactgttgatacacacaacaatgcagatgaatctcaaaggctttatggtgactgaaagaagccagtctcaaaaggtggtgtacagcatgattccatttatacggaatgtgtatgttttagaaaaggcagaactacagggagaggaaatggatgagtggttgtcaggggtaacgatgggggaaggtgtgactactaaggggtggcatgagagtgttttttgggtgatggaagtcttctctatccagactgtagtggtaagtatataactctacatatgtgttaaaattcataaaactctaaacccccaaaaagtcatttttactctatgtaagcttcaaaagtcaaattaaatgtttgaaaaatttcacactgggtatcagtatggacactgggtttttcaaatatatgtgcagatagaaagatacagaagtaaatatagattgtgtaagtgtctatacatatattcctggataccatggcatccagtaacaatgagcataactactgcccagattaggtttctaaataccattctccaattaaaagagctaggggtccttaaagaactggttgatttcagggctgaggcagggaaaatacaagatgagccagaatatcttgtggttagatttcaactagtaaagaaatgctcaaaagagaccaggtgcagtggctcacacctataatcccagcactttgggaggtcaaagcaggaggactgcttgagaccaacagttcaagaccagcctgggcaacacagcaagacccatctctaccatctctacaaaataatgttttttaatgttcaaaaaaaagagaaagaagaaaaaaaatagaggaggcatgtcaaaagggcacggggtcaaccagaaagaactcctaatggccaaagttgggacaacttgaacaacaaaataaataatgacaatactggtttatgataatataaataatggaatgaatcagggagaattctttttacacaaggattttagttaataaaagtaggaggagtgaaggaaatagaaagccacgactggaagaccacagtaagagctatcacaggccagacccaccggtggatgctaaaactagtgggcaaaggttcaaacaaaaacagggtatttccacagtctcaaagaatctcccccaaaatgtctagtaattacaaaggaaaattagtaacctcaccatggagtatcctggctttcaccatcttaattaagtgttaacatctccccttgaacatatcaacatcacatgccccctgattaaaatgcacagagaggggcacatcgctcctggggtatccctcctaattacgcataagctcaagtccaaagtggcagacagtctacaaaatacctgaccaggactcttcaaaaaagtgtcaaggtcatgaaaggcaaagaaagactggggaactctcacagattacaggagactaaggggccatgctatctaaatgcaacatggtgccctaggttggatcctgaaaataaaaagaacgtttgtagggaaactaacaaaattctactgaatcttatagttaatagtactgtatcaagattaattttttctactacaaagaagtactttgtacttaggtaattatactacagtaatataaaatgtcaacgtaatgggaagctgggtgaaggatgtacaagaactctgtactatatttgcaagttttctgtaagcctacaattatctcaaaataaaaagtttcttaaagccctgtgctgaccaaaccaaatcacctactggccagacaatgcacaactacacaaggaatgtgactcatgggccacaatggtgcagcccctggcctacagctgacaccccactcctccccaaaagaagacccaagaagaactctgaacttggtgcagagaagagtccccaagtcagacaccccctgcctcatccccctaatttgtttttcatggccacaccaagagtctatagctagaaaagcacacagcctggtttgaacccaggccctgccacaaactcactgtggaatcctgggtaagggactcccccttcctcttctgaaaacagggaaggggtccacctccaggagctattatgaagctcagatgagaatgtctagctatgaatttgctacgaatttgcatgccctcatgacccagtcacctcctattaggccctatttcctgttgcattaaggattaagtttccaacaattgaaccttgggggacacattcaaaccacagcaacatgttacaattgaggaaatggaggcccacagattttaaatgacttaccctgttacagatggtgatgaatttgtactatacaaaaatcaggggagccaatgctcaggagatttggactctgggaccacctgtgccttgacctggccacagatgtctggcaagtccttctcctgctgagtctcagggtcctcatgggtgactcagtcaacaattagcaaaggaaaaagtcaggctgggtcactgatattgtttggctgtgtcctcactcaaatctcatctcgaattgtagctctcataattcccatgtgttgtgggagggacacagtgggagataattgaatcatgggggaagtttcccccatgcggttctcgtggtattgaataagtcttacaagatctgatggtttcataaaaggaaacccctttcacttggttctcattgtctcttgcccacctaagatatgccttttgccttcccccatgattgtgaggcctccccagccacgtgaaactgtgagtccattaaacctctttacctctataaattacccagtctcgagtatgtctttatcagcagcgtgaaaatggactaatacacccatatatccatttctatgaatatgtcctgttaaagtggtgagaaagtctcattaaatgtagaggaaaggtttgggatggtctggcttaaaataatggccggccagggaaggtcttctgagaagggaaaatttgagcacagaactgaaagcatgatgaggagaccaagccaggggcagatctggggaaaggacttcccaggtagaggaaacagcacaggcaagaacctagaggccgggctgtgtttagagggtccatggagcagcaggctcaataaaggattctcgctctcactgcagtgtgatgaggagtcccaggaggggcatcacaagggagaagaagtgaacaggcgagtgtcatagtctaaggtggggttagcaagatcgctctggttgctgtggacaaaaaggactgtaggaggtgacggggctacagcaacaggccaagcaaaagaggagaaggccttaaaccagagtgctggttaacagcacagcctccggaaccaggttgcctgggtttacacagcgctgccactcaccagctgcgtgaccttgggcaagagacttcacctctccgaacttcaacatcctcatttgtgaaatgaaaaagaaggatacatgcctgatatggttgaatgaagactaaagaaaataccatttgtaaagtgtgtgaaagaggaaatgtctgttagatggggtggtggcagagagggtagtgaggatgagaggcttggaaggcagaacaatgagactggccactggatgggatggtgagacagaaacagaggatggagagtgactccgaagtttttggcctgagcaagtggaagaatggaggtgccattagctgagatgagagagagagggaggaaccagttacaggggcaagatgaggaatttggttcagcacatgtgtagtttcaggtgttattttagatccaagtagcaatggcaaagagacagtggccatacccgggtgcaatccagaggtggggatggtacaaaggacacaagtgacatcaccaggaagagaagaggcccacaggtgggggctggcacccccaaaccatcggaacccaggaggcagaggagaaataacaaaggacctaagcagatgtacgggaggaaaaccgagagcccacagcaccctgacaccgtgtctcaatcataccctgcctgtctcaggagtgagattggtctcgactactcagcagcatctcccagaacaaagacacatcttaaaatgtttcttcagtatccacttcaccactacctgttacccaagtaccccaaggaagaaaagtcattgtcttcaaaataccccaaatgagctggccacttctaaagtgattcctgctcaaacagctcacctgctaatgtcccctccatgtctttatggatctcacgctcctgaatataccacagtcacaacacaaggtgaacggaaagcaaatcagttgcaaaaggaaactgcaaatcctgcaaaagatgcagggttttatgacatcagtgaaagtgatgctggagaaccacagctggctgccaggcaaagctataaacaaataaagacccaggagtcgctggctcacaatgagagtgaagaaagcccaggaagaccacataagaagttccaaaggaacttttctgaccatcagagagtgcacaagaagtccaaaaacgggctccaggggttttgcaaaatgactctttatcatcatgctataaagtgaaaccttacatgaatgatgtggcatcgtgtaatcatttaattttatcagaaaaattacacatacccccaacagtaaaaaataacacttggttccctccttgttgattctaagaattcatgcaatgttgttattacattctaaatacagttactgacgggataaaattccacctatttttaggattgtggttttcttcttcaaagtgaaggactcatctagactctacccccgccaccccacattctcaatattgctatgttagggcccattttcaatgagttctcagcagcaggcctcattttggtaacaattattctgtgacagtgaggccgtcctgatctgcacactgctggaccgaaaggcctccccctcttccctaaagaagccccttttctgggggtcaagaagccgacctgcccacaggaactgggagcccaccagaagagaaaggcaagtgggcgactgggcatgaaaccttgggaattaaatgtcctgggtcctcctgaccccacctgagcccacagcagctccttcccactccactggctggacagaagcagccacagctccctgtgtgtagccagcagaccctcccttgtgcaatctcattgaagtatatacttaaaatgggtaggttcttccagatatcatttctatttctttctctcttttttttttttgagaccgagtttcgctcttgtcactcaggctggagtgcaatggcatgatctcggctcactgcagcctccatctcccaggttcaaacgattctcctacctaagcctcccaagtagctgggattacaggcacctgccaccacacccacctaatttctgtatatttagtagagatggggtttcaccatgttggccaggctggtctggaactcctgacttcaggtgattcgcctgcctcagcctcccaaagtgctgggattacaggcgtgagccactgcacccagccagatataatttctatttcgatgaagcatatttttttaaagtgctgatctgcctgtcagcctacttcctgcctggggtctcctctgacaagcccacaggaggtttaccagcagtggctgccccgctcccacacctgtgatgggtggcagccaacaccagcccagaggacacctttagggcccactcatcgaagctgcaaagatgctgagcgccactggtacctccactgccatccattctgctcaagaaactggctttgggtgggaccccctggtggtgccaaggcttggctccagccactgtgaccacccaaggttccccaaactcatccacagagcctggcaccagatagcagagcggccagccagggctgagctcaggcctcatcgctgatgttcggactccagggacaccccctctcaccctacagaagtacctgtcccagctggccagtctctttgggcttttacctccaaccttcaagatgtcaccacctccaccggtgccagcagcccctctgctttccctcagtaagcctgtgcactcagagggttttgatccaaggcatcagcaggaaaaaaaaagtgcaccaatgtccccaaattcattccataaatactgacgagcccccatcatgtggcaggcggtggagacggagggcacaggaagacagagcttacctctagcaaagggagacagacaacacagcagcaggcaaagccacagggcagaaagagccgggatggatgggccggtgccttccagcagggggttcagaaaaggccatgaggagggtccatgaagacagtggggcctgagcgggctcatggatcacagcaggaagagaatggggctgggctggacccgagcatctgaggagcagccaggggccaggatggctctgggcagagaaagggggtgagtcggggaggtgaggtcaaacctggaatctaggcctgaacaaaactccctgggaggggtcctggtggcatgctgggggcggggggtggtaagcagctggacccccttggaggacaaataagcaacaaatctatttgcctcctttcagggcatgtaggttttggactttctaaagggctaggcaaacctacccttggggacccatcctacagagaccctagaacctgggcccaagacatgaccaacaaggagactcagggagaggagggagagcaggagagaaagaaagtggcggggaaacgggatagggtagaaaagggaggatgggggccgggcacggtggctcacgcctataatcccagcactttgggaggccgaggcaggtggatcacctgaggtcaggagttcgagaccagcctggccaacatggcaaaaccagatctctactaaaaatacaaaaattagctaggtgtggtggtgcacacctgtaatcccagctactcaggaggctgaggtgggaaaaatcgcttgaacccgggaggcagaggttgcagtgagccaagatcatgccactgcactccagcctgggtcacaaagcaagactctgtcaaaaaaaaaagagaaagaaagaaaagaaaaaaaagagaagagtagaaaagaaaagaaagagaaggaaggaaagaaaaagagagagagagaaagaaagaaaaagagagagagaaagagaaagagagaggagggtagggaggagaggaaagggagaggtggaggggagggaaagaggaggaggcgtgggaaggacaagaggtcacaaggatgcgactcctgaccctcccagccccccctccccacaacacactccaagaacctctcagaagcccccttgagcataagatgctgatgaccctctggggacccattctctgggcctcactggtggctagaaacgtccagcaaaggctgcgagaagcgggctggaaggccattcctgacaccctccttcctcaccatggtgacgggcgacagtgcccaccgcccctcaaccctggccctccctgaggaggcctggggaggattcttccttttagccctggaaacagaccctgacactcgtgtctgcttcccccgatcccaggacgacacggcacttatgaatacataaatctcataatcatgtaaaagctggctctgtctagtgatttcttttcaaagacatcataaaggtcctttataaacaaacaaaaaaaaaaaagaaagaaagaaaaaaggctgattccaaaacatcacacattacaagtgtttgaaggaacagcgaatgcccgctggcagcaaacagcccccggccagccggggtccacaagagaatgtttcagaggcctgagcactctcgagctcatttactctctctgctgctccccacattatggatttatgtaagcaggacgacgaaaaccctcgtcttcccccttacattaaaaaaaaaaaaagcaaccataaaacaaaaaacaaaacaaaacaaaaaaacatttttgcaaggaattttataagctgatctggagaacagaagaaggactaaggaaacccctaaagaagtctggttgcaaaatgttctgaaaagaaaaaacaaacttttaacacaggaacacccaatgatacattttttaagtctaattttgaaaaatgatcaaaacactttttttccccaacattacaaattacaagtggccaccagatgctggaggagggaaatatggctgtggtttgttttatcttctctgtttttaagaaacctcaaaattagggaagtcacatatacacaagcaaaggcaaggcaggaaaactgccgatgtgggagctaaacttcacttgcagatggcggaggcttcgagattaacgcacccaggaatcagccacatccagccctagagcgggggaccatgagagaatgtgtgcaaacccaaattgaacttgtaattcacttgatggatttaaaaggcccgtgggaagttttctgtaagccgggaacattttgctgctaagaaagccccaccacccagggaacaggcgggcagtgtcctcgagccttttgcaggatagaggcagatgtttggagatatgatgtaacctgggtgagtgaattcattcaaagatgagtcatgaaagcagccctcaaatgtccttcagaaatctcagtagcagaacacagagcttggacccaaatgcccacctaccaccctcaaacaggaagctcccctctttcaaagaagctctggccctgaggatgatggcaggcttcagctctttggccaccagcttctattccctcattttaccgtaaagtaccctgatgctgcttgaaaggtgttgctcatcccccacctgaggcacacagagcacaggatgaagccaattctttgtacgttgagcccctagatcaaactctacctgaagctgtaggtctagcttcatgggctattatacttcttctcttatatgagtctgactggtttgggttttcagtcactgctatggtttgaaggcatcccccacatttcatgtgttggaaacaaatacccgctgtggcaagattcagaggtggggcctgtaagaggtgactggctcataagaggctctgccctcatgaatgaattaatgcattcacggattaacgggctaatggatgaatggggtatcatgggagtggaaccggtggctttgtaagaagaggaagagaaacctgagctggcgtgttagtgtgctcagcccccctgccacgtgattccctaaactgcctcgagtctctttagaacccccaagaacgttctcaccagatgtggcccctccacctgggacttctcagcttccataactgtaagaagaaagtttcttttctttataaattacccagtttcaggtattctgttatgagcaacagaagatagactaagacactcactcacacattgagccccaccatgcaaggattaaataaaaccctgactttagctagaaccttcaaagttcggccatgtctaccccttccaaataaccaccaattcagaatggaacaagttcctccaatgtcatggaaggttcccagcttcacccaacttcacagtgcgatctaccatctgcttcctcaacatctccatccaccttcatcacgggacaacctgcagagcctcaggccctgactctgctcctcaccacagaggttttctgagtaataatgatggtaataacaacatcatcaacagtcagggcttgctgagagctcaggatgggccagtgggcttgctctaagcacgttcatatggttatctcatttaatacaacacccttagcagtgggtatcattagtctccccgtgctatagataagggagcggagtcacctgcccagagtcacacagcttgtctgtggcagggccaggctatcagccagcccccacgcagccacttgaaatgagtatttttatgttgatatgagtaactatggctatcatatcaaaaccattatttcatgaacattattaagctgagactataaagtttttaaaaagggaggaggttcagattgagtaaaaatattatatagacaatgttgtgactggtatttgaatattatacaaatcataagactgatactgaaatgagtatattgcaggaaatactggacggacagatgaacagacggacggatgacaaatggatggacagatggatggacaggtgggtgggtggggagatggatgggtgatggataaggaggaaagaagaagggagaaaaagaatgaagtgaagaaggggaggaaagaaggagaaaaatgggcctggcacgtagtaggtgctcaaccaatatgctgaatgaacccattagcaaagaagtagtagagtgctgtagttaagagtgtgggctttgaagtcagactgctggttcatgacttggctcagcctttcctcgctgaggaaccctgggcatgtgacaaaacctctctgtgccccagtctcctggactgtgaaatgggacaataggaacacttccatcaaggcagccagaagaaataagtcagttaatgaatgcagaatgctcaggacacagccggatgcatcctaagtgcttggtaagtgtcagctaacaatatgatgagtaagttgtcaaatccattctagggctgacccagtctaaccacctctctatttcagaagcaacctcaagttccacgagcctcccccgaaagtaggaacggaagagaggaaacagaggaacaaaaggctccactctccccaggctccaaggaaaaaggagggtggagggctgcaaggtaatttaagaagtttaacagggaaaaaaagtcttcaacatgagtgcggaaaaaaaaaagataaattcaatggtccaggctgcctctcgagacagctaaattctgttgtgctcattctgcatgcttcagcttttcttagactctgaggagtttttgcctaaattagagcctgcaatatgctgaagagaagaaagggaaggtgaagggaggcagagaaaggatcaggggcctgttaggcacgccctagaggaagcctggctgttccatccactccaacactgaatgccgagacagtgaaagtcaaatcccagcacctttccccacagccacagccacaagctgtgggttgcacccaagtcccacagcccagccctcagtgcactcaacactttccctgccatatcccaacatccccagcagcagccacccagattctccagaacatctgcttacctctacccaccctgtccccatcagctcccaccctccccagtcaactgaaacattactggctgctcaggtgactgctatcaccacccgggaaccccaacacatatttattcccaggaatatgtgagagggtgagagtgtgcgcatgtgcatgaataatgcatacactgtacttatgcaaggagatatgcatgcagaaaacggcaccccagctagctgacttggaactgtgcagattcatgcacacacacacacacacacactaatatcactcccttcggtaaacacagacagacaaagcacacagaaataaatcgttaccttcgcgctgctgctgccagatggcagagcctggcattgctgtgtctgcacgtctgtgcatttgtgtgtaataataacggtggctgacatgactgagctcctaccacgtgctggacgctgtcctaagtgctgcatcaaacccagaggaggtgttattattacccgtttcatagctggggaaaccaaggcacagaggtcaagtcatttgccccaaggtcaccctgctggtgaggggtaaagtcaaggactacagaataagcacccaatatgagcaagtctcgttttatgaccctggggggtgacagggaggaatcccaagatgaccagctgccatgggggtcctcaacaagcccaccgtcccagtgatgggtcaggtttcaacacaattgaaacggacaagagccagaactccccaggaaagaggggtgcccaaggttcagaaatgtttgaaatcaagttcagtgtccagcaaagtcctcaccaccagcaacaagtcaacccgggggcagagtatgcaaactggcaacccacaggtttggcccacagtcatgtttggtttggcccatgaagtgtttgttaaaaatgtgattgagttgccaacttttaaaaatcgagtgatttcataccaaaaactccacatttcctgccattggaaaatgtctttaagaagtcaagagatctggcaataccgggctcgagttcccgcacggggactgctgcctggggctgagaggtggctgcttgcttgacatgggacatgtgctccagaaggcacagattggggttgggggcctgcctgtgggggctcacttctgtgcctcagtttcttcatctgtaaaacagcttccccataggactggtgtctggcacccagcaagcactcaataaatgttaaatagcactgctgtctccccaacatccaaggcccagggcttgaggcattgttttataaaaataagagctaaggccaggcgtggtggctcatgcctgtaatcccagcactttgggaggccaggtggatcacctgaggtcaggagttcgagaccagcctgaccaacatggagaaacccggtctctactaaaaacacaaaattagctgggcatggtggctcatgcctgtaatcctagctactcaggaggctgaggcaggagaatcacttgaacccagaaggcagaggttgctgtgagccaagatcgcgccactgcactccagcctgggcaacaagagcaaaactccatctcaaaaaaaaaggagctaacacacatctagcacccgcgctgtcccaggctctgttctgagagctgtactttatgaactcactcaatcgtcccaagaaacctatgagaccattcctaggtaaaagcccaagagaaataaaaactatctccatacaaaaacttgtacactcatgtgcatagcagtattattcatagtagccaaactgtcaaaacccaaatgtccatcagctaatgaatggataaacaaaatgtatatccatataatggaatatgatacagccataaaaaaggaatgaaattctgacacatattacaatgtggaagaagccagatacaaaaaaaaaaaaaatacacacacacacacacacacacacacacacacacacatagtatgattccatttatatccatttatatgaaatgtccaaatctgtagagatagaaagtacattagtgggccaggcatggtggctcatgcctgtaatcccagcactttgagaggcaagttgggtggatcacttgaggtcaggagttcgagaccagcctggccaacattgcgataccccatatctactaaaaatacaaaaattagcctgacatggtggtatgcgcctgtagttccagctacttggaaggctgaggggggagaattgcttgaaccggaaggcagaggctacagtgagctgagatcgtgccactgcactccatcctggataacagagcaagaaactgtctcaaaataaataaataaatacatacatacataaataagtagactaatggttccagggattggggaagtggaataatggggagtgactaccaatgggtttgggttgtttttcaggtgtgattaaaacgttctgaaattagaagatagtgacagttacacaagcttctgaatataccaaaagccactggagtggacactttggggaattccttatggcatgtgaattatactcaattaaaaaattaaaaagagaaacacctatgagataggcattcttgttattcccattttacagatgagaaaaccaaggtacagagagattaagggtaaagagatgttcctctatatccacatcgatgttgaaagtagagagacaaagttagggggagagggttacgtgatttttcctgcactggctgctttaccggtcacagccatagggatctggatttgcaacccttgctcgggcaaatcatttactctctctgagcccgaggcaaaggccagacaggaatggcttttctcttaatcttgatccctctcgggtccccaaggaccctacaagtctggagcattacatggaagcattacttattcatatgtaagggtcagttctggccattaataaatgatgattttaacgactcacagtggtccactcccagggaaatgggaagaaaccattctgggttttctaggtccaagcccttcacatggctggctcagatgtcaaagcaagtggctcagtagcccatctcctcccaagtgtctggccaggagaagaaccccttactcaccaggcagaatatgacctcaccgggctaaaggatcccctcactcactagaagcccccatgggacaagaggacccctaccccacagagtgggaggacccccttatgaacacccccataatttggagcagcaggctctcactgagctactgggagctgcaaacgagcccctctaaaccaaggccctgtctctgagcacggaagggacctcaaggtgccctgcacctcattctcagatgcagggaccagcctgtgaatgaagtatcagaagccagacagtgagagggagaaacagagggagataggggcacagagaatgagactgagacagaaaaacagagagagggaaggcaaggggcggacagagagtcctgaaggaagctggaggcaaagctgggaagacagagctaaccaggacaatgaaaacaagagctctctctccactccagaaggaaagaggccaggaggcagagaggaggcccagcaggagcctttgcttggggtccttcccacactgcagggcagcaccagtactgcccaggagcccccatcagtgggtggtgggggtggcttcccagccaggctggagcctgccagggcagcctctgcagaggaggaggccggctggtcaggctgggggctgggccgggaagtgccaagcacccagccaggttgccatggccacggagacaaagagaggggctgaggagaggcccagggacagggtccctaagaggggccccggctgcctacagtcctcggggactgggccttggatgttggggagacagcagtgctatttaacatttattgagtgcttgctgggtaccagacagcagtcctatggggaagctgttttacagataaagaaactgaggcacagaagcgagccactgcagtatctcataggggtttttgtgactagcctatgagttgattaagtgaaactctttagtacagttcccaatgtattgaaaccctcacatgtcaactattattgcaaaatgtcaccaaaagtcaggtgacattgttaatgtaattctcttgcgtccttatcctcagtcactaacatgacacctgatgtgtcatgtatgtatttgatgaccggcttactgtctgcctcttaccagagggttagatccataaggacaggggctcgggtctgttccatcacccactaaacactcagctcagcccagaactgtacctggcagagctgggatgctggttctgccacgtatttgctgtgtgacccaagacaaatgactcaacccctctgagcctccatttccttatctgtggaatgggaatacaatgatgatgaccttgcccacatacagagaggctcaaagaaggatgctcctgcagcactgcttagtacagaccagtgactttcaaatgagggcaattttgcttgccccaaccccccacccctgaggacatatggcactgtctggagatatttttggttgtcacaactgaggaggagggtgcttttggctggtgggtagagccagggacgctcctaaacattctacaatgcacaggataggataatcccccacaacaaagccccaaatgtcactagagctgaggctgagaaatccagaagaaaaagaaaaaggcaggaaccaccaagatgcccatcaagaagggaatgaatgtataaactccagcagaatcgccctgcaaaatggtaggcagaagtcagaaggaagggcctgaaactgtgtaaaacaacataaaaagattatccagacatacacatcccatgagcaaagccagctcagaatgctaggtgatcctacgtttaccctcagggacccagaatttgaacccaggagctcagccccaagcctacagatttaaccacctgctccaccagcctctgctctgtatcttttaccaaaacaaatgcacgtgctcgaaagcatgctatgtcactgctgcaggttcacatcgatgtgtggcaatgacatgaacaaacacacagggaaagatctggaaagctgcacaccagcctattaacaagagcaactggggctggaggcaaccaggaacacgaaggggtaggttacctcatccacaatgcattaattttctacaagaagaatgcatttgtatttgtcatgttatgaaacattaatgaaaaattacaaatacatacactctttaacccagaaattccattcccagaaatgaataaacttacaggtatgaagtggcatgtgtctgtcccaccatgatttgtaatggcaaaagatgggcacaacctcagtgtccatcaacaggggactaatttaataataattaaaaaaaaaaaaaaagtacctccattcaacagaattctatacagctatcatttttgaaatgaggcaattccatgtgctatcatggaacaacctccatcatacaggcacaaagcaaaatgcagaaacgtgtactgtgggccccacttgtgtaacaaaaggggtacacccagactatctgaaggggcctgtatgacaccggggccagtggctgcctctggggagggaacttggaggctaacatttcattctatctcactgtatgctttttaatttgaaccatgaaaatgattacacatttatatatttatatatttatatgtgtacatatacatatatactgtatatataaatatccagttatatgtgtcgtacatcatatatggtatatataacatagatgtgatataaaatgtatataaaatagttttatatatgtatatgcgtaattatatatacatatatagttatatatacagttatatacacatataattatatacacatgtatagctgtaacattttaaattaatttaaaagacacaaaagatcatatactatataattccattttacataaagttcaaaaacaggcaaaactaatcttcgcagatacaaatcagaacagtggttacttttggggatactgactgggagaagacaccctctggggtgctggcaatatctgatctgagtgacagttattcagatatatcttattataagctcaccaagccgtttacttggtgtattgtacattttgcatacaagatatacctaaaataattaaaattttaaaattttaatggaagaaaaaggactgatcacggtggaaagcatttctggaaattctctaaattctatcatccccctttaccagagggagctctttgcttgggtccctgagaggtggccaagctagggtccagccccgcaccacaacttccccagaaaaaagccaaatgggaatcaagctggcctttgtggttgagtccagcagagcaggacaaagggccaaatgacggccccctgctccccccagaccccccccaggacactgaagcccattcatgttggaggctggccatttccccagggctccagccccctcctctcaggagctgggaacaatatccccttttaccacccctcttgtctctcacttccgcatttaattgcaagttcatgggtattaagtggcccatacagctgacccagctctctctcccctcccatccccccaaaaaagaggcccacagcgctgtctctgttcactgcccctgtgtgcccgctctttctcaatgatcttccccagagagaaagagaacgacacccccgtcggtccccgcttgtcaccttcctcaaacaaccctgttctcacccagaaagcacagtctggcaaagcgagctgctcgtggccctggcacagggcgccaggcctgcaatggcagctctgtcccgactttcccggccagcggcacatccactttgcaccccgctgtaaccccacctgatgcctgagaacactgaggcccaggagagtcgatgacaggcctgcagtcctgacagagccagtgctcagaccctcaagattcctcagcctggatctgtgactttccctaagctgccttcttgtccccattcaagggggtgcccaaagcctttgactcttaatctcttctctagctttgcaattccagggacgacgctgagctcatctgtaacctttaagggttgggaagaagtcacgtaagtcaatctcctgccttttgcatgaactcacttttgcccttgcccatggggttcctacctctggaatgtcctcaagtctgccgcatctatcctgaaagtctccacctcctccaggaagccttccaggttgtatgggtcaaggtctagtttcccctcctccactgaaaaactttatcacccacattcctccactaccaattcaagtccaacccagctctatctccatccacctcctggtccaagccaccaccatccctcactggacactgaggcagctacctaaccaatcttgctgctcctacggtccagcctccatacccacacctaagggtcctttttaaatcatccatcagaccactcttctgctctgcttaaagccctccccggcaggctgccacactgggaggaaatccctgctcctcacctcttcctggaaggccctgcatgctctgtcccattaccctcctcagccttccctccctccacaccagcaccagcctccccgctgcacttaaactctgacaagtcctttcccacctcccagcccatgcgcttgcaaactgaagtgtacctgtcaatcagctgggggccttgtcaaaagcagattctgctgcggtggatgtgaggtgagcccaagctcccacggtgatactgccaagtccctggagcacacgtggaggagctttggcatgcagtaggtgctcaacaaaattcatctcctggtgttatattcacctgactaaatttagaaggaactgtgtatctgaccctcctgctgggattaaattggaatcgcttcagatctatgcaagaccctgacttaaatctctaaatatgaattaaataacttttttctttttgagacagagtctcgctctgtcgcctaggctccagtgcaatggcgagatctcggctcactgaaacctccacctcccgagttcaagcaattctcctgaatagctgagattacaggcacgcgccaccacccacagctaatttttgtatttttagtagagacggggtttcaccacgttggccagactggtcttgaactcctgatcaagtgatccgcccacctcagcctcccagagtgctgaaattacaggcatgagccaccccacctggccctgaataaatagcattttaatttaaaatataacagctatcatttcttgagtgcccacacattttctttcatttaattctcaagactctcatatacacttggttgagggtggcaggagcttgctgcatggaagcccctcacagtccccaagtgagatccccactgcccaccacaaggacatgcagacaggcctggaagaggaaaacgttcgaaacatccctctaagcctgtgtccacccaagcacactgtcagtggcatcctaaaacgaagagcaactcctataaaccctgtggccctgccccgagcagcgcggtctatcaccctggagactgcatgtgctaaaagcgttagctggttcaaacttaagtatttcaaaagccaccctctggggccccagtcttatcctacatgcattttgttaataatacagccaaagactggaggggccttggcttcctgtgtaccccatgggtaagggttttccagccccattttagataggtggaaaatggggtacagagaggttgtcctgcaggcaagcgggcctctgtccccccacaacagggcagaggggccagctgggttgaaacccaagaagaaagtacccgtgttctcctgggtgagggggcaggggctgcgggcacaagggccctgcttatcagtggccaccagtacctctccctggctgggcacctccacccatccagataggatctcactctaatctgcctctgcgccaggggccagcagacccctgccataaagggggccttgggggactttgatgtggtagaggacagagccagcctgacttgtgggccagctgtggcggaggggagagcctaaggagcttcaaaacagtctcagcttctctcctgtccatgtgggactctggagaatttgaataaagctatttcaccaaactttacactcatttaaacttcactacaacccttaaggtagctactataatcaccccacgttttacaagtggaaaactgaggcacagagagcctaaatagcctgctcaaggtcacaccgctgggaagtggcagggctaattcaaatgcaggctgagctgacattaagggcctggatttattgataagccccttatcagtagggcgaccaacagccccagtttactgaggtctgaggggtttcctgagatgtgggacttttagttttaaaaccagaacagtcctaagcaaactggggcagttggtcactctatttaccacttgacttatcagtgagaataaagataataatagtaacagcgacagcagccaacaatccctgggcacttaggatgtgtgcccggcatcatgcaaaccccaaagcctcaccacacagtggtcctgtgaggtgggagcttttgttccctctctttccctccctcatgtcacagacgaggaaaccaaggaccagggaagctgcagaacttacctacgaggcgtaaaagggagtacagcctctcagatggcaaaagcagccagctatccatgtactgagcctctcgggcagggctaaaacaaggccccaagcaccatggtacatactgaacacgggcctttataatgagaccaatgcctttaacatacatgacacatgacctaaccactctggatgcaaatatctaattttttttttttgtagtgacaggatctcactatgttgcccaggctggtcttgaactcttaacctcaagcaatcctcccgccatggcctcccaaagtgcagggattacaggtgtgggccaccgcactcagcctgtggatgcaaataattatgggatttctaaagatatgttagcttaaaatctgccacttactagctgggtaacctttggagagttcctgcctatcaccaggataaaatggggataataagaatccttccctcacaggctgcagtgagtatcccacaagattgtgcagctgaagagcttaagacatggtctagctcgtgtgaagaaccagctactagtagcagtattcgtactggcattagtgtctatgccatcataggcagcgtggtcttttgtggaaaccatgcgagctgcgtaagcaccaaggaacatctcctctttcagcaactctccatgcctcatgcatcggtgacactgaaggtctaattctgagaagctggccagtcgggctctccctcttgctgagaaaatgagaccacaccaggcctgacaaccacacacctgcctgccctaagtcatcttgaagcaagcccagccccaccacgcagagacacccaaagagcttcctaaaaccatcctgcgacagagtcccttctggtcagagcaccatcctccagtaggtaagggccaaggcacagtttcacctccgtggatataggctttctgttgagaaaccagcctgcgtcctgcatccagtcgctcctctcctcccaccaccaccctgggccaggacacccacgtctctccccggggctgttgcagtcacctcctcactggtctccccacttatctttgtcccctgctatggtttagctatggcttatttgtccccaccaaaactcatgttgaaatctggtccccagtgaggcgatgttgagaggcagggtcgcatgggaggtgtttgagtcatggaggcggacccctcatgagtgggctggtgccatcctcacagtagtgagctctcactctggggagtctggattagttccccaagagtgggttgttataaagccaagacgccccttgggttttgtctcttcactcatgtctgctttctctctgaccttctctgccatgccatgatgcagcaggaaggtcttcatcagacaccatggccatgcccttgaacttcccagcctgtgcaactgtgagctaaataaatctcttttctttataaattacccagcttcaggcgttctgttataagcagcagaaaacaaactaagacaccctgcacacaccccatccccacccccgccaaaccatctactttcttcacggtagccaggtagccagaggggttcttttaaaaggtaagtcattcactgtcactgcctggcctaatgctcctacagcttctctacctcttacaataaaagcccaaccctttgccatggcctccaagaccctgcccaatgcagcccccacatggtgctcagatctcttctcccacccattctcccctcactcactctacccagccacaccagcctccttgatgatcctgaaattggccaagctcatccctgcctcggggcctttgcacaggctactcttcctgccttaattcccatggctggcttctcagtgtccaggtcccagctcaaaggccacctcatcagacaggcaggccttccctgatcatcagatccaaaacagcccccgactctaattcatatctctgtgttactgtctgcatagcacttgtcacttacaagatttttctcatttgttatttcttcattattcatctcccccatcccaaacatcagagatatgagagcagggattgtatctgttttgatcactgctgtttcccccatgcctggcacacagtaggaccttagtcagtatctgctgacagcatgaagacagcagaaaacaagattcctggagctctaagtatgcctgacatggtgtgggaatcccccattccctttgcaacaagggctctgagagaagccaggccgttctgcgagcttgtaacaggggccctggcccaagctggggagtgaggagcgggcaagccaaggggggctttcctgagaagacgccttagacccccaccacccagcgtgctccctggaccagtggcatcagcgtctcatctcctgggagcttgcttagaaatgcggcatctcaggccctactccagacctgctgatccaaaatctgcattggaactaggtttgcaggtagttcagaggtatagtcagatttgcgatatcctggtttaaacccccagataagtaggtaatagcaggcatggctggttcagggcatccctgggaaccaaaaggctcacggcaggcccacgaggccaatctcatgcaaaacatggcttcccagcagcacaggccagaccagaaaaagcactgaggcccatccagggaccccaagcatccttcctccctcagacccaaaataggatccaagaagctcagagccagcatatgcgggtgggggagggagaacagggagatgaacccaacagatttgcatggcagactccccgaaagccatgccatctggagcccctttgtgataaagggaaggggaacagagtgagagccaggagtattttcaaggagtggggtaagggggcaaaagaggtatgtacagggagagggagggccacctgtcaccaagaccagcagcaccccaattccacttcccaaccacctgcaacacacagggccacacacgccaaaaacagcttgtaatccacatagcatcaccccttctgcagcttcccgaggtctgatatcctggaagtcgtgccctgagtcctgctcttagtacatgtggttgtggggcagccggcacctcaccccatctacactgacgaacctgtgacccaggcgtgggcaatcagagctctggggccctctggatgggtgatacttggttcatggatgggtccatgacctcaaggtcaggccagggaacacctggatccaactgtgcctgaggccattactcctgagtcaagtaagcccagaaagtctttttttgtttgtctgtttgcttcagactcttcaagttagggtttctgtcacttacaacccaaacagtcctgagtgatacagctgttacagcacctatcatcctgtaatgtctcacttaggtgcccattttctcccctggactggagcccttgaggacacacaccattgtttgagtcatctgcgtttctgacgcccagaagaaggcctgggatataatataatcttcaggaaatacgtgacaacgactggatagctcgtccttctttcactctgcaaatatctactaagcacccactatgtgccaggcactgttctaggtgtggggacacaacagggaataaaagagacaaaaccccctgccctctgggagcttaaattctagcgaaggaagagcaggcaagaagcagaggagtcaatcaaatacaagtgccacggagaagagggagacagagggggagcatgggaggaggggtgactttcgatgggaggccagggaaggctgggctgagagggagaggcccaagacctgaagaggtcatgagtgcacaaatacctggagaatgttcccgaccaacaggacagcatgtgcaaaggccctgaggcaggagtgtgctgggcacttttggcgaaggagtcagaagaccacagactacagggcgttgggatttcctctgggtgaggtgggaggcagcgggggctcagataggacgaatgtgacctgatttacgcagggtacatgtggagaaccaggggcaagggtggaagcatgggacaagggaggagacgactgcaagagtcccagcaggagaccatggtggctgagacccggggctacccatgggaggtgagaagtggccggatcctggctgcttgtccaagttggagctgacaggatttcctgatgggttggatgtgggatgtaagaggaagagtggcgtcaagatggcccaaggaggtgccagagtgactggaaggagggggccgcaagaggagtggcggggaggaggcagcaagtttgtgatgcctgctgaatgccctcatggagatgtcgggtcatcatctagaggtcgggacagaggtcagggcaaggaatataaatttgagaaatgctggcagggcattttaaatgattgagcaagatgagctcaactacagaatgataatgaagtgacagaggaagagagggaagaaatggtccccatctccttaccaccgggctgccagtgcccaccagcctcctggctatgtgccggggagaagaaacggtgatagcagcaggacatcaactccttgttctagaacagcttgctatggacaatggagtttcacatccactgtttagcctgctccaaagaggtaggtagggcaggaattagcattccccaccccaactcatcacccagataagaaactgaggctcagtcagagaaggacaggcgggtgcaaggtgatccaggctaactcagctggctgagccacccggccaaggccaggctgcagacaccacgtgctctctgccaagtgcagctcttcaggagcagaaacagagagaccccctccaccctaccttctgcggctgccaaagacctgacacacggggaggggctgagaatatgtcttggcccgaagtgttgtggtgactggcagacaacaagtgctggcagcgaattagggagccaggaggggcagccagcaccacacacagggctgggtctccagggtcccctcagcaccgggggctcccttcttcctggacttacaggccagccccaagcccagaatcccacctcacccctctgtgccccccaacagccaccaactcttgagagagacaccagggatggggcatcctgctcccacctcagccacagggctcagcctcagggatcgagacccaggttcaaatcccagctccagtgccaactgacaatgagacttagaaccagctgtaacacctctccaagcttcaatgtccccacctgtaagacaggtggcaaatacagaaacacttccatcatcactgccgccaaagcagcgaacatgtgctgagctctcaggatgtgccagacactgctctagaccagggcttctcccgctcagtgccactgacaattggggccaggtaatactgtgtgataaggctgtgctaggcactgtaggacgttcagcagcatccctggactctacctgcttcatgacagtagcaggtagagtccagacatccttcctccccagttgtgacaaccaaaaatatctccagacattgccatatgtcccctttgggggaggggccaaactgcccttgtttgagaaccactgttctaagcccaccagaacatcagctccaggaggacaaagatctttgtccattcatcaaatctagggcctggatttgaacttaagggacctggttgcacaacttgctcagacacctgctatcctgattctcaaaggcctatgggagggtttatgtgacccaatattacatacaggtctgccccacagtaggtgtttctaaatggtcattttttgtttgttctaaactctagacttggttcattattattaataacagctaacataattaagcatttattatgtgccaggtaccaaatgaaacatcttttgcacaccatcactcatttcagaggtacaatgatcctagaaggaagggattactattactcccactttattaaggacaaaactaaggttcaaacatgttaaatgacttgccccaggtcacactcccagtaagaggaggagccgggactgaaagataacataccagcgcctctcagactttgggctttcagattggtaagttccctgacaagggagcaacaagcatttaatgagcactgactgtatgccaggcactgggctcagcatcagggataccaaggtcaagatggcccccaaacagctccaacagcaggcagaaggtgaagagggctcagtgccagtatggagggctggggctggggaaaaggaagtcagagatgcataagagtagcaggaatggcttctcagaagaggtatagggacagttcaaaggaatccgatatccattcatccatggaacagtcagagaacgcctcttcaaggtgacatctcaacagaacatagctgaagatggaggtgagccatgctgacatgagggaaaagacaactggcagggaactgtcttttttaaattattgttagtctatattaatttgaaaaatagtgtgttaattagaactagtgtagcaatgccaaaaaagtatacaaagataaagtgaaaattctttttctacactcccccccattctcagcctgaggctaccaaggctaacatctggtgcacatcctgcagtatctttctccacactcataaatacccattgagagagccttttttgtgtttttttttctctacaaaattggggtcctgctctacatttcactcagcaacttatccctccttaaaggtacagcacatacagcccctcatgtccatagagaccaacctcattctttccaacagctgtccgttaccccaacatgtggatcaacaaccatcctaatgagacttttctctgctaacggccactcacagagttgccaatttcttttgccattagaaacaaaactggaataaacatctttgtaacttacatctttacctactttttttttcttgtttctataggagaagttcctaaaggaactgaatcaaagggtatcgtgggtttttatttttaaagacactgccaatgtattttcccccaaggcagcaatcatgaacactcccaccagtgtcctctgggactgcttgcttgcctgcagccaggccagcgctgggcattatgcctcttgtgtacgtgtgacgacagtaagggatggaaggtgacgttgactgatagggtttctcagcggaaatgcagctccacacagttccaaaaaacactgccaattccagagcattctgggcccaaatgaggctagaggggtgtgggggagcaggctgtccactcagggggccctgagcaagatggggacaccttcctcccaagcccctccccatccttgcaagccgactcctgagcctgcaccatcctcatttctgaaatggatttcacacccaggagtaacaaagatggctttgtcagtaggaaaggggaggggggcactgttgtcggaacattctggatcctgttcattcaaagctctgtgtgtggggatggagagggcagagttggggaacaacggggtgcttcctgctctggggctgacctcaggcacaggcaccgtgggcagagctggagcggccccaaattccctgccatcccctcactggcacactccacaaacatttgctgagagcttaggctgtgccaggcactccgggagcactttacatttatcagctcatgcagttcatccccacagccccatcagcgaggtcacatcattaacaccactgtgcagatgagaaaatagagctccaagaaaagcagccaggactcgaggtcacacagctcgtgagcagcacaggaggacaaagcaggggcagtggactgccatctagccacctgcagaacaggctctcctgcccgggctgctgtggcagcctcctcctcagcctccaccccacctcctatcatctacccgcacaagtagccagagggatcctgcgaaaactgagtcagatctgcccctcctctgctgaaacactccaaggacaacaccacctcactcagcgacaccacctcactcagcgtagaaagcaaagcccttacaatggccctcaaggccctgtgcaatctgcccaccagcctccctactcctactgccacctctctgacttgacctcccattgctctgcccctggccattccggcctccgtgtggatcctaaaacaggctcctgcctcagggcctttgcacttgctgtttcccatgcttggaatgctctccccataaagacagaggcaaagtccttttcctgatgttacacccctagaaggggcagagcctggattcagggaagacaaaatgcacacagctgagtcttcaatagaagagaaagatgctgtgtgactctgggtaggtcagggaacctttctgagcctctgcttcctcatcgacacaataaacaggcaacgcaggaacaccttccccaccaggttcttggggggctatgttgcttggaaagtgtccactgggcacagttcctcacacatgtgggcaccagtgttataatgacatccacagggagagctggaatagtcaaggaaggcctcccaaggaggcaggataggagcaaggattctgaggtcagacatggaaaggccaagagccactgcaagcaggccatgggccaacggggctcccctgggacccaagacttgggggaaggcaaagccttccaatctgggatcgaggcaccagcacaggggagaagagatgctcccacctggcatccctccccatcttctggtcccagcaccctgggggcttccttctgggaaccactcctcccccactaccatgtggtagagctacatccctcacccaggaggcagctgccccagggaaacagagagaaattcccattcttactgaaggtggtttgagatgggttttctgtcacttgcaaccaaaggatcctgacaaccagccggctcttgccaatctcagcagtggtagcaatgccattgtctttattattgttcttgttatttcaaaatcttcaagatgagggagaaacgaggccaggggagaggccaccaataggctgcccaagagcaggaagacaccaaacctgaccgggatggtatcagggtcctgcaacctaagaagaggcccaggcagggaccctctaacgcccctggaggaacccactacttcctcccaggttctcccaaaggggcataagtgcaggaagtaggacggaccatgtgggaacctcctgtttaatagctgatgttgcagaaaagagaagggagccattgcccacaggccacaggaagtggaagtctgggaaacagattcgcaccctctaagagagacccaccttctccccttttcatctcaaagaacaagaaggaccactcacaaactggaaaacaagtctccaacttaaaacccctataggagctgggcaggtaacagggaatgctgtgcgcggctccttagtaaaagcaatgactattgtatccttttaacagagaagagtgtctttgcctagtaaacacacaggaatactcttctcttccaaagagaaacctgctaccttccactttccttaaaacacataaccctcttggtctttcagttttccatctgatacacgcaagggttagaagaaacattcctctgtcctcttaattctacaattaaaaaaaaaaaaccaggcctagtacagtggctcatgcctgtaatcccaacactttgggaggctgaggcaggagaatcgcttaagtccaggagttcaagaccagcctgggcaacatagtgagacccttatctctaaaaaaaattttttaattagctgggcatggtgacacacacctgtagttacagctactcaggaggctgaggtgggaaggtcaccccaggaggggttggaggctgcagtgagctatgatcacaccactgcactccagcctgggcagcaaggcaagatctcacctcaattaaaaaaaaaaaaaaaaaaaggcagggcacggtggctcactcttgtaatcccagcactttgggaggctgaagcaggtggatcatctcagatcaagagtttgagaccagcctggccaacatagcaaaaccccatctctattaaaaatacaaaaattagccaggcatggtggtgcacacctgtagtcccagctacttgggaggctgaggtagaagaatcacttgaacccgggaggcaggggctgcagtgagctgagatcgcaccactgcactccagcctgggcgacaagagccagactcctcctcaaaaaaaaaataataataataattaaaaaccagcagggcaagtgccataataaatggcaaccaatgtttggtctcagtgttaggaacatgttatggaggggtggagactgtggctaaatgaagactgaagccctgtgccctgcagaaggggcagctgctcttcaggtccagccaaaccaaacgttgcctgcagaagagcaagtgacacatcttctgattactaagaagccagaaataataggtttttgtatgaaatgtcttcatttttcattgctggcaagtaaataacaattttttttttattattattaaacatggggtttcactatgtttgccaggctggtcacgaactcccgacctcaggtgatccacccacctcagcctcccaaagtgctgggattacaggcctgagccactgtacccagcctaaacaaaaaattttaaaacaatcccgtgcaggctgacaaaacccacatatgagcctaacctggacttaggacccctgggtttggaaccagtggttctgatcataagtaaaaggaggggccctgctttcatcacatctgtggcctcagtagcttgtacaaggcctggcccacagcaagggtacgatcaatgacttctgaccagagttggatacacacacacacacacgtgtgcatgcaaactactgaccagacctggatacacacacacacgtgtgcatgcactctactgacaagacctggatacacacccccccacacacacacacacgtacgtgtgcatgcacactactgaccagacctggatacacacacacacgtgtgcatgcacactactgaccagacctggatacacacacacacccctcacactactgatcactgaagtcaaagaatctgaaagtgaagtttcctagagacaagggaatcccctaggacaaaacattcatccaactcatttggatacaacttaaacctccctctctgtcctccaaggagtcttagctgttggacaaaagcagactatcacggaataggagtcagaaaacctgggtttcggttccatctcaaccgcagacccacttgggatccccaggccaagtgactgaacagctcggtgcctcaatttccccttcctgaaaagcgagatgattggatgagatgatgtctcagtgtcttccagctccaacagccggtttccaggattctagtgctaataatttctttgggctaataaggaccaaagggtcctaaacccaggttttttcagccctcagttactaaattgacaaaagaaccggtagcaatcaacaaagatgcagatggactgtcattgtgaaaaactgaaaactacctaaatgccccaatataagaggaatgggtaaataatataagaggaatgggtaaataacataagaggaatgggtaaataatataagaggaatgggtaaataacataagaggaatgggtaaataacataagaggaatgggtaaataatataagaggaatgggtaaataatataagaggaatgggtaaataatgtaagaggaatgggtaaataatgtaagaggaatgggtaaaaaatataagaggaatgggtaaataatgtaagaggaatgggtaaataatataagaggaatgggtaaataataattttactagaatgctattattaaattatatattagtataataattcttataagtatagctaatatatatggaatgcttactatgtacctcgcattgttctgatagctttgcaggtcctaattcacctaattcccccctcaatctaagaagagggcactattttaggagatgaggaaaccgaggcacacacagatggagcagctgggccactgaccacacagcaggcaggcagtcaggatttgaactggacagtggccatgatccagcccccacatttcattacgaagccatgaaaggcttgctgatggagagcatttagcagtgacacgaggaagtatgcacaagcagtacctgctgtcgtgtaccaggctcagaccaaatgcaaggaacaaagaggaaatatacccaaagatgaaacagctatttggaagggtgagatctttttattcatctttatttcccaaattttctaaaatgagcgcagtaactgcaaacacagtcatacgtggtgggcgtcctagggagccggctccacacccagcactcacctactctactccacccccaacggcccagatgtcggcctgccctgcatcctgctgtatcccagcatctgggccaggcacacagtaggtgcttaacacaatgtgttggaacaagggaacaagtctatgaggtagggacagcgatttccccattttatagctgaagaaactgaggtccaagaatcagcttcccgaggtcacagagctggtcacagagcttggctctgggacaagcatgagcacatctcagtggagactctctactgaggacaatcaaaatcaccagagctggactgccaaatacaatgcgtgatccaggactagatcctggactgggggtggggatgggcgaggagatgggtatagggaacacttggggagaaatagtgaaatctgaatatagactgtgcattgtatcatttagtataaatgttgacttgcctgattttgttgttgaaggcactgtggttacacaagagaacgtctgtcttcctaagtgatgcatgccaaggtttgcaggggcatcctgtctgcaattactctcaaatagatcaaaataataataacgtgtgtgtgcatgatggagacagggaagaagaaaggaaagggagagggggagcgatcaaataaaaagttaccaaaaagttaactctgaaaagaacatattaaattgcccagaaatacaacatgtttggttttgtgcctagactgccatatgtgtgtagaaatgaataatatatgcagccaggtatacacacaaaatatcattttaccatactgggttccataagagcgcctgtagctgaacagacataagggaatgtgcttttgatactgacacctccactgtatttactacctttgtgttcaaggggaaataaatctttaaaaccacccaatcaacagcttggtgggccactggctggtggctgagaccacccagagctccctgacgtggcaaataaaactttccaatccctttgccctccccagtgtggtaagggcaggaggccaaggaacccaggctgcggctgcccctacacgtgggttcatgctcccaagacacagtcatggccaggaaggcctctgccacagagtgggccccattcagccccttttgctcatgcattcatttcttccacaaatgctaacacagtccccattaagtgctaatcaccagggacttggccatgaacacagcagacaagggctgtgacctcatgcaacttacattctaatgggagagacagatactaaacaaataaatcaacaagataattccaggcagtgacaggtcaagaagaaaatcagtgcagtggcgtagagaaagggactagaaggctctctgaggaagcggcacttgagctgagagctgaaagagaaaggggggtccttggtacaaatcagggttccaagagctccaggtaataggaagagcaaaggaaaaggcttagaggctggagccagttgaatacagtgcaagaatagaaagaaatgtggtggggcctggacagaatgaacaaggcggggagatgaggtctgcacagtgagctaaagctggatcacataataccttctaagccatcataaggagctgggattcgattaacctccatgttccacctccagcagagtgaggatgggggaggaagaggactccttgtgctgttaatgtccgtagcaaacaaaccagaatgaaatggcagggtgttggagctaaaccgaaccctgtcagtaattacattaaatatacataagctaaacagtctaattaaaaggttgcgactgtcagaatggatttagaaaagcaagacccaactatatgatgcctgtaggagatgcacttggaatataaagacacagaggcagaaacgaaaaaaatggaaaacagtaagcagaagaaaggcaacatggctatagcaatatcagacaaaataggcttcaagacaaggagcattatcagagataaaaaggagtatttcataatgataaaaggatcaattcaccaggaagacataatcataaatgtgtatttccagcaagagaactttaaaatgcaaaaagtaataactgacagaactcaaaggagaaaaacataaatctatagtcacagatggagacttccagagccttctctcaataactaccagaacaaggagaccaagcatctgtaaggatatacagatctgaacaacactaacaaccaccttgatccaaatgacatttgtagaacactgcacccaacgacagcagaagacacattcttttcaaatgtacatgaaatggtccctaaggtagactatctgctgggtcataaaccaagtctcaatttcaaaggattgaaaacccacagaatatgttctctgaacacaaattggaaatcactaaacaatgagttatctggaaaagccctaatatgtggagatcaatgcaatcagatgggcttcctcactccccaccccacactcagagtaaacagcacagacaacatctggcgtaaatgtcccctgggagaaagcagtcaggcatctgtcccgtggccaggtctaagcctacactcctaggtaacgggggtaccaggatggggtagatgctctggtttcaacttcaacaacccagttggcaaatcatttcaagagatgctggggcggccgggcacagtggctcattgcctgtaatctcagcactttgggagtcagccgagtgggcaaatcacctgaggtcaggggtttgagaccaccagcctggccaatgtggcgaaaccctgtctctactaaaattacaaaaatcagccagacgtgttggcacatgcctgtaatccccgctactcgggaggctgaggcaggagaatcgctcgaacctgggaagtggaggttgcagtgagccgagattgcaccattgcactccagccttggcaacagagtgagactctgtctcaaaaaaaaaagaaaaaaaggaaaaaaaaaaaaaaaaacagagagatgctgggggtctgtgtactgtgttggagagaccaggtcttaccagcgaggaaaccacacctcataatacagcccacctgccccgtctcgctcagaatgagccagaatgaggccaacagccaatcagttcaccttactcagggttcactctgggcagggccagagagggagtaaataaagtaaagcacagtggtcacaaatatgggctctggagtagaataatcctgagttcaaacccaccactgaccattgttggtgggcagaaccctgagatggccccaggatcactgccccctgtgtccacgccctggaggatcctttcccatttcatgtaagtgggactgtcattgtgactggtaaatgacagaggcgaagggattttgcagatataatcagggtccaaaatcagctgactgagtgagcctgacctaatcaggtaaagccttaaaagacgcctgcgggggataaagcagggagaagagtacaagtacacttctaggcccttcctaaaggaagagattcaaagcaagtgattcacctgctggccgtgatgtggctatgttgtggcaggaccacacccctaagactcaaggcacctctaggaagtgagggtgatcaccagccaataccctgcaaaaaatggggaccccggctccacaatgcacgcaactaaattctgccaacaaccctatgcagatccctcccatgccccacaccctcctcgctccaagcatcagatgagatcacagcccgggtcaacaccctgatggcagcctcatgagaccttcagtagaaaacccagttacattgcacccagacttctggcccacagaaacttcgaggtaattaacaggcgttattttaagccactaaatgtgtggtaacttgtttggcagcaacagataactaatacgccatctctgtgtgatcctaggcaagtgacctcaccctctctgggcctcagtttcctcatctgcaaaactgcaaggctgtaaatgaaacaggatgtgtaacagcctcacccagaaagtgggaagcagcgtgttctgtgccctttcaggttcatggagggatttcacagcagggcaatgggaggtgctgtcatgtatttttgagacaccaatctgttttttcaatcttcggagggattgcttggagaagagagtgaacagcaacttctagctccaacttacagccatcccagttactcccaactgccttcagagtgcacagaccaatgtccagggcaagggaccacttggtcaaaataaattcagtcacttatttcaagtcccaggaaggatctcaggcagtgtgttcaagatgatatgctgtaactgttcctctgcaaaaagtagggaaatactaagattctaaaacagaatgtttaaaaataacctcactaattactggggcctgctcaggtgccaggcagtgagccaagtgtctcaacatattttatagatgaggaaaccaaggttcagagagggaaagcttcttgcccaaggtcacacagctgctgaggcgcagagataagattcagacccagacaatctggctaggcccctggcacttgagcacaatgccacactgtaaaaaattctcctgtgcaaaatcccccagctcacatacccacatagtcaaaagacaccagaccatcttagtccccagaagtctgcacaaaaatgcttagcaattatataattcaaaacaatcacatcatgtaataaaacataggcacatatagaagcaatttttttcattcaaaaaatacttaatgagcatctactatgtagcaggcattgttggtgctggagatcaaaatctctattctcttggcatgcctgtgacattccagcgagggaggcagacaataagtaataaataagtaaaatgtccagtgtgttagctagtgggaaaaaaacaacgcaagcaaaggaagaaatggtgaggtggggatgtgcggtgtcagaaaagacccagtcaagaacatgattttgagcaaaggcctgaaggaggtggagggctgagccacggggacactgggaggtgggagggagcgcattccagacagcacaggtgcaagggccctgaggcaggtgcgtgcttggtgcatttgagaaaaggcaaatgcgcttggaggaagtgggcgagggggtaagagctacccagaagattctggaactggataatggggatgactgcataacttggtgaatatactcaaaaccaccgaatcgtacagtttgaaagggtgaggtttatgatttgtgaattcacatctcagtttttaaaactttatggggaaaaaggagtaatgaaagaggagctgagagagccaagaggggcaggtcttgtgcgacattccaggccagactaaggactgcttttatgctaagtgagatgtaactgtaactgattagggtctcactggatccctctgactgcgtaaggagaacagaatgcgggaggccagggcgagatcaaaagagtcaactgcaacggccctggccattcccggctgcgcgtcctcaggtacgccacttcccctctctgcagctattttcctcatgcaggaagtgggcctgaaaaatccatcccccacagggcagaggtgagagctaatagacagtaaagtgctgttatgatgcctatgcatggagggtggagtaccgatcccgccaaacagtttttaattatgcaaatgagtttcctgaacagaaaacaaggggcaccttcctttgtctcaggaagcagaggttcatctcgcatcaacagccctcccagcccagaggcagctgccttcacagctcatccacattctggccacagatgggggcccaaactcctctttgggtgtggttgggtccactggcctcctccaggaagcctgccctggttacttggtaacccagtacccacaggaaagctgaaacccaaagagaggacagaaccagccgtaggtcacagagcagcctgggagcaggcaggggatctgctgtgggaggggacggtacacccattcctctctgagaccttagtaagaccattgcacagtcttggtttccacgtcaccaactgacccatgccatatccaactgaaagcactctggtggctcctcacaccaccagaaataaaacccaaactgctcaccatgcatctgaggcccatgcgacctggaccccaccaacatgccaatctcatctcccttactctcccctccagccaccctggcctcttactgttcctcaaacaagcctggcacagtcctgcctcagggcctttgcatctgctgctcccactgcctggaacacacttttctccactctttccaccagggctccttctcctccttcaggacttggtcaaatgtcatctccctagaaaagccttccttgcccatcccatctaaagtagatgcgaccatccctgtcacaaacatcacctcattttatttccttctgtctgaatccactccccagctgtgtggacttcagcaagttactcagcctctcccggctttagtttccccatctgcaaaataggtataatgatgatattgacctcagggagttgctgcaagggctcaagaagcatgtggcacagtacctggaacagagcaaggcctcagtgggtgtccttattatgacaactctggtccttttctcaagggatttctttttgcggtgtctgaagattccctgagggcagagaccttgtctgtcttgttccagccacatgccagcacctagcacagtgcctggcacacagtgggtgctgaatggccatttattgaatgaataagtcgattagtggatgaaagcatcaactgcccacaccctgaccccggcctcgctcctcctgagagatgcacagaagccacccaccctcccagcaaggggggaagcacaagaccctgggtcctgacggccaatggccacctgcctgcaccagctttcagtggccccagtcccgccagcctgaaatagtctcgcctcccctggcccagaatcaagggatcgtctgtcagttccatcctggggaaggaatcaggcgggtaaacacagattgagtgtctgaccacaagacaaaagaagagcagacagattcccttctggtcctcaaggagccaagaaaataaaaataagctcaaaaatctacacagggctggaaggctggagggctctgcttcttccttgggacttcctccgggaggaggggtgagcccgcacacagtcactgtactccccagagtaaccctaggagtgctggggtcatccccattttgcagatggggaaaccaggactcagagaggcaaagcaacatccccaaggtcacacaggggaagagctgggatctgaacccaggcaaggtggctcgagagtctgtgctctaaaccatgaaccgcaagagagggagcctcccagacactctgctgggtgaaaagggcaaaccgtattatgctacttacataaacacatcaatctcacgtatttccacacaggcatgctaatgcccccacacgatctgagagcacaggtggtagtcaaaggagcttttagcccagtggttctcaactgggggctatttttcacacccaaccacctctagtggatacctggaatatctggagacatctgtggttgtcacaactggggaagaggggtcctactggcatctggtaggtagaggccagcgatgctgctaaacatcttacaatgcacaggacagcacccccacagcaaagaatggtccagccccgtatgtcgacagtgctgaaggctgagagactagtgggatttgctccagaccaacgctagggccagaaatgaccccgtgaaacctcttcaagagggacttttggccgggcatggtggctcacgcctataatcccagcactgtgggaggccaaggcgggcagaacacttgaggtcaggagttcaataccagcctggtcaacatggtgaaaccctgtctctactaaaaaaatacaaaaagtagccgggcatggtggcacgtgcctgtagtcccagctattcgggaggatgaggcaagagaatcgcttgaacccgggaggcagaggttgaagtgagccaagatcacgccactgcactccagactgggcgacagtacaagactccatcttaaaaaaaaacggggggatttttgatcctggctaaaacacagatccccagaaaaggatgtgggccaccaagctctcttcccaggtatctggggatggaactctaacaaactgagtggctactgcccttaactggtgctcacctcccctctggggacgcaatttatgtcacctgcaaaacaaggagattcagaccgaatgacccacctggcttctgttcaagatctccgaaacgcagggcaggaatcagctccgacctggccccatgtctggggaatgatgctgtgggacacagcacacaggtttgaggggcagcccaccctatcacccacctccctccagtattctagccagcatgcctgtgtctgttggaaaaaaagaaaagccccaaaaatctggagaggtcaggttctcctgcagccaggcatgacctgcttcaaacacttaaactcttgcaaaacctttaagggagagcggctgtgaagcaaataggatgtgggtttctttattaaagggagtggccccaagcccaacaggtcttcagctctctggcctgataaaggagtatctttctctccaagaaaggggtgccctgaagtctcaaaagccagagacaccaaccccattcgcgtcttcttaaagtgacagttaaattgctaccagggcaaacaccagaataaaagtaggtaggcttccagaaggtttgtctgaagaatgagttgtagaatccccacagggttgtccttcttataaggacaacgacctgttgatgacttcattctcgtggcccagaacactgcccaggatatacagcagatgctccataaatacctgcacacagagaaaagcagtctcatatcttcatggttttatctgtacagagctctctgtctgccatacattaaaaaaaatgtaacccatctaaatcctgctgacactcagtttttaccatcaaaagattttcactgacttcctgatgatgatgagcccaacacaaggtggcctgttccaggctctccggcatctgaaaactgaaataaggtggactttttgacttaattcttgcccacctgggcagcccagaggtctcacaggggcagtaattttgctcatgaacacagcctcattttggtgcaattcaggatagtggtgaagaatgtgggccatgcagccgcattacctgggtccaagtgccagttctgtcaggctgtgtgaccttgggaaactgacttggcctctctgtgtctttgtttcatttgtaaaacaggaagcataagaatacctgcaacttttgagttaatgcttaaggaacttataaacagggcttgcaagtatataaatattagcaaattgttaccattattactgttgcattaatctaataaccatgttgaaaatacaattcttcctgtcggcttcttaaaaaatatattcgcatacatatgcataattttatatgaaaagggtattataaacaggattttacttccttatcttcctggttgcctttctgtaaaagatacacatccttccatccttttctccaacctaatgtcaccttatacatataacacacgtgtatattatggttattgtttattttccaaaagaactgtgttacatatacctctcagcatcctacttttcatatgaggaccacgtgaaaatccccccaagttactggggaggtccctctgcctcaatgactgtgaaatcaaagacctgcccccaccccaaccacccgtggcatttctccctagtgtgagactaggagtacagaatcttttaaaacagaaaaaaaaatagtgacaacaaaaaaccacagtttcttgtttggcaagcggagctccaatgagaagaaaaacttttgtctcctccctccaaaaagcagaaccacagaaagcattctgggagctttctgcccacaatccctgttcctcagagactcccatcctggtcggttccgggcagaccctctgtgtctctatagctctctgtcctcagccacggggagaccttcgaggagctgctgaccaactcccacccaccggcctctctgcccacccacccaggccctctcttctctttcgaccactgcccagctgacacaccccatcatgggagttactggcacctgcccctgaggtgcctccccttggcaggtgggcccaaggtctactcagcctcctctaggggagtggggggcaagcttcaccacatccctgtgacgcaggtgctacactgtgcccgttggacagatgtggaaactgaggcacagagcaagtcagtgatcagcccaaggtcacctacagtccaagtggaagaagcctggatttgaacaccagcagcatgactccagagcctcactcaaccctcgtgccatgaacagacccggagcccagagcaagaactcggcagcctgccatttctatccgtccacagttcttcccattctgtggagaaaagaatgggagtcacagagggcaagtaacaggaggaagcgcaggcggaggtgaaacatcacacagacctgggttcaaatcccagttctgccaccttaataaatcatgtgccaagcccttcttggatcagccaaaggcggtctatcaagtggctggggacatgagttgtggggtcaggcagcctaggatcaaatcctggcaatgctgtccacctgacccagagcagctcacttagattcactttgcctcagtttcctcacctctcaatggggataaaaacagcatccccttcataaagaaaattaaatgagttgacacatgcaaagtgcttagaatggcaagtgatgaatcaaagtcagttcctgcacagcaatgactgtcattgttttcatcatgactaacgctgcccagagcacacggggagtaccccacatagccagggcctcgaaatgattcgagccaaggttctgagtcaaaaccccaggcactgtttcccccaagaccgatccagcatctctgtgaaagggctgtccttgccttttcatgattatttaataaacacacgcaaaacaccaaactcagaggactccctggagatgagggagggagtgcaacccagttcctgaaggagatggggaaagatgggaagattctcaaggaaccacaaagccctcggcctggaaccaaacaaaaccactggttcctgtggccggagtttagggtgtcaaaaggaaactcactcagagcccccatcctcctctcagtgctgacttaactcagacctcacttcctccaggaagccctctctgatcacccctgctctctggatgctgaagtcccacaaccctaattatctgtattatttaattttcctacaacaacaataataaccaatatttatataccttactgccagacactgttctaagtgctttacatcaatttctataactcacttatcttctttaaaaacctataaaataggacctattaacatccctctttttacaaataaggctcaaacaggttaaggtgtttgcccaaggtcacaagtccaaggatttaacctcaagcagtctggctccagagccttgcacttggattgttttttttaaacacccatttggccatcctccactacaccgtcctctccttgaggacagaagccacacatggcccctatcacgggggttactttccacggtttccatgggccgatgggaccttcacaccaaggacacacggagaccagggtggtcctttaaggcctgcctctaaccacatggaaataaaagcagggagggattaccgtgcattcttccaagccaggagacagcagggaaaatcccttagcaaatataaaggctgagaagagagagtgggaagacagaagagaatcacaacctgaggctgccagccttgcaaccatggaaagccttggtaattagcagttcctgaagctctaagccccaggttagttttgaaaacgaaaatgccttgggatgtttaggggccattcctgacgggccaagatgagagaggactcctgtggctcacaaacaacgtatggctggtcaggttacacaatccgtctgtttctggcaccagcttggggacacacaaaaggcccaggcagaaaggaagcccggattccccgctccttgtttcacaggtggggaaactgaggtcaggacacgtagcatgattggtccaagacacatgtccaagtcagaaccaattcatctcagaactgacacatcagatacaaaaagaaaaatgtgatgaagtcagcaaatgtaaagtgttaaggagataatgtgaaagtagagaaatctttttttttcctgtttcttgaataataagaatggttggctccaatcaatttccattattccagcttcctcctactctacacgtggacgatttaaaaccacagttaactcaaacacaatctagatctgttctaaaatgaaacacaccatctagggcaggggcgtgggagggagaggtatattttctttcccattaatatcaaaattggtttgtatttcctgtttctcttccaagcagaggagcatggagtggctcagaaggagaagtcaggagttccctagaatttgacattgctcagagacaccagggttgtctacatgtttaattcaaaaactgccagcttctaacagaacaaattcttcccccaccccccacccccgaaactgtgagagaagaagggatgggaaagaaagccaatcctgccttattcttacaggccttcctagaagggtcctttagccaaatggttttcaatgcttctgcacaaccccctctcccacatccccctgcccccagtacatctcctttcacaggcagaagggctctagtctaaggctgtctcctccctgagctggaactctgatctcacacagcctcagctgcacccctaagccatgaggagccccagaggaccccagagtctccctctttctcccaaagactaggagctacaaagcctggctctagggtctttgaaagagccacccccacaccagcccttcctgaaccaggattaaaagacttcctagagcagagaaggggagtaaatgaggccccagcaggaggcatggagattaaagactttagagtctcctaacttccatccaaggctctgccccgtcccaccccctccacccgctggccacttttctcacttcctaggagagtagggaagtggccccttcctccctctcacagaaaaaaagcaaaagaaaaatgcagcatagaataggggtttagaacaccagctgggatagtcccggttcaaagcccagtacccccacttaatcagctgtgcgatcccagacaagctacccggcccctctggagctaaactttcccaatcttaaaaacggaggaggcaggacccagtagctcacgcctgtaatccctgcactttggaggccgaggtcggcggatcacttgaggccaggagtccaagaccagcatggccaacatggtgaaatcccctctctgataaaaatacaaaaattagtcggccgtggtggctggcgcgtgcctgtaatcccagctactcgggaggctgaggcaagagaattgcttgaacccgggaggcggaggttgcagtgaaccgagattgcgccactgtactccagcctgggtgactgagggagactccgtctcaaaaaaaaatttttttaattaaaaatgggggaaatactcgtccctacttcatagaccgcctgtgaaggttaaacctgctaattaatgacacatgtaaggtgtctggcacatagtaagtggtcggttgttattttacaaagtctgaggccgtggttttgcacttggagatggggagttggtgggggtggatgcagttagggagcctggactgccgagttttgagttcgaaacccactctccccgaactccagcaaaaacctgtgcatgggggattctaccctggggttctgtcaatccccgcccctcctctgagcttcaggttttatcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcgcgcgccgcggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggacgcagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttccgtcgcgccgagcggcaactcaggcgtccaggcgccccatcccggacggggcgcgccggcgggccgggctcagcggcgggccgggctcccggcgcggcgggcgggactgggggccgggcggctgggccgggggcggaggcagcgcgcgggggccgggcgaggggcgggagggggcggccctcggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagccgggagtccgaggccgcgcgcacgccgaaccgagcgtaccaactccgcgcccggacgcgtggcgcccccccaacccgcagtcaccgcgggctacgccactcccacccggcacacgcgacacccgccgcgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccatctctctctttccttccttccttttctttctgaacttctttgccccctgaccctgccctttccacctttcccagaagaaattattacctgctcttgagttattgatcaagtggcaggtaccctgcctgctcccccttccatccacccaccccatgggataaggccttgggaaacccagcttcttgtcaggttgctctgggcaatgttgatcatcacccgccttatcggaaggtatggagaggggaggaagttctggggcctagagtcagctgctcaggttcaaatcctagctccccacttgctggccgggtggccttgggctggtttccttgcttcaagatcctcagtgttttcatcagtataacgggaacgatcatggtacctagctccaaggtcctccccggggttccatgggaagtacttagcacctagaaagttctctgtaaatgtttgttcttactattattgcatgtgtgaagcccaacacctagaaagttctctgtaaatgtttgttcttactattattgcatgtgtgaacggccctctaagcctggccccactctcaaatggcccatacaatccctaatcacccgtgtttccggaccagagattgtatcgtctctgcaggggataaagtgatccacatagtatccgcctctagactgtagtcattttatggacagaaacattgcttatttattcctgttccaaaagcctaggattttcctcccattggcctctcaatactgtaagtgcctaaggacacagggagagaatggggtggcttctgccctctctgacttctttctttgggatcatgggcaaggtagcatttgatctgggccttgggctgagtgaagttcccctgggcagggagtaaaggacatgagataggtgagcctgtcacgcttgggtagtggagtcaattgtgtccaaaggtagctggttttttatttatatttttattcctaataaaggcctctggagtatctctgctttgtgactttaaactgttcacggtacctttctgagcctccgtttcctcatctttaaattaattctgtctaccacgaggggagaacatggctggaacataatggaccatggaatgaagcgggcttgcatttgtatcccagtccaaatccaactggcagggtaaccttggccaagacacgttatttctctgggcctcagtcgtctaatctgtaaaaggggagtctttgtgagagcgaattctatgcaatacagactttctcaaccttgggactattgacatttggagtcacataactctttgttgggggaggggcgtgtcctgtgcatttcaggacatttagccgcgtcccctacccactagatgccagtagcactccctccccaatctgagaatcaaaaatgtctccaggctgggcacagtggctccggcctctaatcccagaattttaggaggtccaagtgggaggattgtttgatcccagaagttcaagaccagcctgggcaacatagcaagaccctgtctctacaaaaaaattttaaaaattagctgggcatggtggcacacacctgtagtaccagctgctgggctgaggtggggagcttgcttgagcccaggaggtcagggctgcaagtaagctgtgatcacaccactgcactccaacctggacaacagagtaagccttgcctcaaaaataaacagaaaaagtgtctccagacattgccagatatccctggggacagaattgccccctgttgagaaccactgatgtaaagtacctgacacacatagctggcacagagtaggtgctcaacaaatgttagttcccttctcagcccatgaccaaggaaggttagcctcaagtttacacacaaatcccacatttcacccaagaattggcccacactgccaaaaaacatttccacgttgtggatgggtcccatctctggcccaccccaatgttttatacatcgttacttcctcagattctgctgggatctttttccccttccatccccatccccagtggtaatgatgacactaaaagataatacagcgtttagtaacatacttaagctctctgtgccttgctttcctcatctgtgaactaagaataatatcagtacctacatcataaagtcgttgcaaggttcctgagtgcatacatggagggtgcttagagcacacagtaggtgctcaataagtgaagtcttttacaatgcgtggattgagtgctgaatctaataggatgcatttggctgcaaggagaagaaaactgggctattgatagcttaaagcataaggacattatttagcaagaggtccagaggcagttggttcctgaggctggtgtaggacttcatgatgtcatcaaggatcatggcacctttgaccctcctatcctcagcatggtggcttttcctcccaagctttagggcctcagaggcacaaaatggctgctgaaacagcaacattgcctcctcacacacctccaatgaaggaaagaaaagtacgaagaagactctgtctcctctgtgcttctctctttgggggaataaacttaagctcccagcaggtcagcactagaagccatggtcacccttgaaaagtccctgaccgagggcatagattgccaccatcaacttagaaaagacctgcttagtcccctggcacaaggctgcccagacaacttggagatctgttgtcaagagagaagaggagctagcatggtgggcatctataagtgtcggccacaagcatctactacacactgggcattgggcggggtcctgaggctgcagcactgagcaccccaacagctgaggcccttgtgctgccggcattattccagcaagggggataggtgaggatgaagacaagttcctcctctcatgcattcaactattatatactgagggcctcctatgctccaggcagggatacagcagtgaacagaacagataaggtccctggcttcctggtgtgtccagtcaagagcagggagagaaggacaataaataaacaaggtcctttcagcttctctaaggcctgcaagggatgggcctggggaagcaccattggttggtggcacctccaggactctgcctcaggtcactaccccagtgtcatgattcagccatcaggattcagccaggggcctcagccttggcgggatcagtggggactccctctcttcaaaacctggctgcctcccagctaatcctggcataggcaactccctaaaccaaacatgactaagcagtcaggctggagtagatctcttcctatccccatttcaactttgacctctattcccttcttccccatcacccgtccggaatatctagtggggagcctatctgtctcatgtgtatgtcagggcagggcctgaaacagccggcagctgggtaacgttctcaaaaagaacagggaggaagaagaaaaaaaaaaaattgcagttcagggggaagaaaaaaaaagtgatgataatgatagggaaattctcttttgcagggacaattttagagtttccgttgccatgtactttgcaaatagtgggaaataccatttcgtttctgttacataagtttcacagttgagggggagaagattctgctgcttggaaacatcagagtttcttattccctgacaagcccctgtcagcttctgcaggctgaggatttgaaggcccccttcccaagctctgtttaaaaggaaaactaattaagttaaagcaaggaaaaacaagtgattttctttcccatcccaagttgaatgagccaattgagaagtgagttactgcactgcccgagggtgccatcatttcccaaatgcaaatgagttctcaaaagtcagaccagcagcccagagcagggctgttcctcattctgagaaccaagagcagctgtctgagaagaagagggaggcctctccacccttggaattagagcagctggacaactcaaatcaacgctggacacacagcccagggttcacttcttcccaccaaaatataatcgtcttcctagtagttgagctacccccagctgcccaagtcaaaacgtctctaagggaagccttgctgttggaagcacattctccagggggctctggttcaaggtctgatttaagcataataggtatccaattaagtcagggctccacagctttgccaaatcatacttttgccaggaggcattggagacactgctttgaggaagcagaaaggaaaacatctaggaccctcagttccaatcccactctgccaccaacatgcacgacttcttctccagcctttggacattgttgtagcaccagagaccagcttctcagcttcaaatcccagtcccactgcttcctaattgtgtcactttgtgtaagtgacttaacctctctgggcttcaatatccatatctgtaaaatggggtcagtaagagcttctacctcacagcgttgttgtgcaggttaaaatatttaatagatccaaagtgcatagtatgctgcccgatccttggatgggtgtttgctattgtaagtggatgaagccatgatgtctggagctatgacagccatcttgagaccctgagataggacacttctaactaactgaaggtgcaaaatgacagatggaaagaatctggatctttgatgtcactgagatcctgaattaaccaaccatggaaccaccctgcctctagacttcttgtattaaaagataataaaatgtataacatcccattttggaccttatggtcaccctatcttttctttcttttttttttttttttgagatggagtctcattctgttgcccagagtggaatgcaatgccgcgatctcggctcactgcaacctcagcctcctgggttcaagtgattctcctgcctcagcctcccaagtatctgggattacaggtgcccgccaccacgcccagctaatttttgtgtttttagtagagacaagatttcaccatgttggccaggctggtctcaaactcctgatctcaggtgatccatccgcctcgacctcccaaaatgctgggattacaggcatgagcacggcgcctggccgaccctatcctttcaaataagcattgacctgacttcttgctacttttaaaatgcaaatgccagccgggcgcggtggctcacacctgtaatcccagcactttgggaggccgagacgggcggatagcgaggtgaggaaattgagaccatcctggctaacacggtgaaaccccatctttactaaaaatacaaaatattagccggtcctggtggcgagcacctgtagtcccagctactcagaagctgaggcggagaatggcgtgaacccgggaggcggagattgcagtgagccagtgagccgagatagcgccactgcattccagcctgggcgacagagcgagactcagtctcaaaaaaaaaaaaaatgcaaatgcctcagaagggtgctggtcttcaccctattgctttcctaatggagcagagacctaaggtttataacgtgaaggctggattgggagtaaaagttgagaaaagggttcagaaagagactgatacatagaaggtaaattctgcaatttcgtcaaggccagagatcgacctggaggaaatatcttgaaattttgcagccaggaatgccagatggtttcaacagacatactggacacacatttatatgtctgggttattttttttttcccagaactgaaagctcaaaaataaagctgcccagtccaaatccagacacctggcaaccccagtggtaacttttactgaaagctgatggtttcctctgtagccggcagaaacacaaacagccacaccctctccaaatgccatttaagccgcagcctgccttccaaatttccagggcaaattccattcctgagccttttttttttgagatagggtctcactcttgtcacccaggctagagtgcagtggcacaatcacagctcactgcagcctcaaccttccaggctcaaacactcctcccatctccacctcctaagtagctgggaccccaggcatatgccaccagaactggctaattttattttttttgtagagatggggatcccactatgttgcccaggctggtcttgaactcctggcctcaagcagtcctcccacctcagcctcccaaagtgctgggattacaggtgtgaggcaccacacccattttttgagtgctcactctgtgcaaggcactgttggattacaggcacctgccaccacgcccaggtaatttttgtctttttagtagagatggggtttcaccatgttggccaggctggtctcgaactcctgacctcagctgacaccagcctcagcctcccaaagtgctgggattacaggtgtgagccactgtgcctggccctgagctggaagttttatacatcacttctgctcccaccctactggccagatcttgccacccagatggctctgtgattctttgccaagccatgccaagccactgcccaggtgttgcaggtgggctgtgggaatcttgtttccttgcgctgaaacagcaccaggcatgtgtaaataatcattgaatgaatcaatatctccagtatatgttttggactccaggttgagagaaacctcaccgtgaatgcctgggactgttctaggtactgggactagaatagtgaataaagcaaaactctgtgtcctcctgttgcttacgttctagggacagaagagacaataaataaagacccccaataagttgacagagtcagccagatcatggtaagagttacggagaaaaacaaaatggattaaacaacagggagcactggggccagcacatgcctggaggggatgagagaaggcctccctgagaaggtgacatttaagcaaagaactgaaagaagtgagggagtgggccccacctgtgttccgggcagcaggaacagcaggtgcaaaggcttggaggtaggagtgtgtccacttgttcaaggaacagcaagggggaagggtagttgagatgcatctagaaaggagaggaaaaccagatgtatgagccatatagttgaccataggactttggctttttctttggatgaactgggagctaaacagaggagagctatgacctaacttaggttctaatagaatccctctgacagctctatgggaagtaaactaagagcagggtgaggtcagaagcagtaagacctatgaggaggatactgcactagtccaggcaagagacattgatgacttgggccagggtgataccagaggagatggagagaaacagttgattctggatatgctctaaagatggagccagcaggatttgcagaggatctaggggtgaaatagagtgaaatagagttaaacacgactcgactctattagtggctcacgcctataatctatgatttttggagttggcattaaccacgatgggaaagatggcaggggtcggtggggtgctgctttggtggagaagatggagcgtttggttttggccatgttcaatgtcaaattaaatacccaagtcagatgttgagtgggcagtcacatccacaatcctgaggttccagggagaggtcaggctggagatagaaatgtagccattgtcaggatataagtgatagttaaagccttggggctgggcgagatcacccagggagggtatgtggatggagaccaggacaaggacagaggtctgggtcacaccagcattcagaatgaggcagccagtgaatggaggctggaacaggggtgagggacagttccaattgtccacaggtgttccctgactcctttaagactagacatagcaatggactctcctgtgatctcattttccctcgtgaaatagacagagggcaaagtctggagtgcagtggcacaaccatggctctgtcatctcctccagagccctgagccccaatttcttattttgttaaatgaggacattaagaaccccactctggctgggtgcggtggctcacgcctgtaatcctagcactttgggaggccatggtgggaagatcacttgaggtcaggagttcgagaccaacctggtcaacctggcaaaactccatctctactaaaaatacaaaaattagtaggtcgtggtggcacacacttgtaatccccactactctggaggctaaggcaggaaaatcgcttgaacccaggaggtggagcgagatcgcaccactgcactccacctgggcgacagagtgagactctgtctccaaaaaaaaaaaaaaaaaaaaaaaagaacctcgctctgccagctctctgagggacacagcgacataaaaagaacttacagaccccaaactgctagaaaaagtgaaaaggagttccttcccccaccatctaaccttaatctttcagaaatgtgaaactgaagcataggaaaatacttacatagattcagagaaaaccaaagagaagtagtggccagtgagatatcatctcacactaatcagaatgactattactaaaaagccaaaaaaatcacagatgccctgaggttgcgaagaaaagggaatgcttatgcactgctggtgggagtgtaaattagtttaaccactgtgggaagcagtgtggcgattcctcaaagacctaaaaacagaactaccattagacccagcaatgctgttactgggtactacccaaaggaatataaatcattctaccataaagacacatacacacgtatgttcatttcagcactgttcacaatagcaaggacatggaatcaacctgaatgcccatcagtggcagactggataaagacaatgtggcacatttacgccatgaataccatgaagccataaaaaataacaagatcatgtccttggcaggaacgtggacggagctgtaggccattatccttagcaatctaaagcaggaacagaaaaccaaatacctcacgttctcacttataagcaggagctaaatgacgagaactcatggacgcagaggggagcaacagacactagggcctacttgagggtgaagattgggaggagggagaggagcagaaaaaataactatttggtactaggcttagtatctgggtgataaaattgtctgcacaacacacccctgtgacacaagtctacctgtataacaaacctgcacaggtacccctgaacctaaaataaaagtttaatgagagagagagagacagagagaaagaaatttaaaaattgaaagaaaaaaaaaaagagtggtggcagagaaagaactacttacaactccatgcaataacatgaatgaattttagaaacatgatattgagccaacgaagccagatacaaaaaggtattatacatgatgtaggtatgattccatttatacagagctcaaaagcaggcagtattgaactacagtgctcagaggatgcagtgtgaatatagcactgcatggcaaagctgcaaagaaaagaagccaggcagcggtttcctctccggttgggaggggtctgggattcagatgagccgcacaaaggcttaagcggggctggaaacgttctatttcctaacccacatggtgacttcacagggattcactctggaatcatttgttaggttttatattgatgtcttatgcacttttccctatgtgttctctgtttcctaatttaaagatgcatcaaaaaccttaaaaataaatatatatacacctatatttacagcctttaaccaagttattcccattctgttcatctaaactacagaaaagaatcacacattcagacaaacttcgatgcgcaaagatgtgcattgcagcatcatttataatagccctatatttgaaagaacctaaattctcacaagtaagtaaatacttaaatatagtatgtccccaatttggaaaattatttagccattgaaaagtctgatgtcaaagaatatttaatagaatagaaaaaaatgctcatgatacatagatgaatggggaggaaaagagcagaaaataaattatgtgataattaaacatgtactccaataaataaatgatatgcagactgtgatcccaatattgtcaacatgtattacatattcataggaaaatgacagcaaggggccaggcacagtgcctcatgcctgtaatcccagaactttgggaggtggaggctgctggatcacttgaagtcgagtttgaaaccatcctggccaacatggcaaaaccccatctctactaaaaatacaaaaattagccgggtgtggtggcaggcgcctgtaatcccagctacttgggaggctgaggcatgagaattgcttgaaaccaggaggtggaggttgcagtgagccaagatcgtgactctgtctcaaaaaaaaaaaaaaaaaaaaaaaaaaagcaaggaaatatattttaaaataacaagagtagttacatctggggagtgggataattatgggtgtttgttttctttatacttttttcacatttccccaattttctgccatggatgtatatggctttaattctttactacactgcttttcctcctcttttgatttggaccccagatgcacagaatcagttggtcacactccttgggccatttgaccgtcaactgcattagactatggcctaggttttgttttattttcacttcttatttttgcctctgtcacccgtctccaactcctcccatttccctctcccccacagacacccacttggatatatttaaagcttgttctttagatccatctgccacacatttgtttggatctatgggtattcaaacaggcatagtagaaaatatatacagagataaagacatagtgttttatctgtgttttcaaatgtttatgtaaatggtacagagttacgcatttcatactatgttacctttttcactcaacatcctgtttctgagatcctgctttgttgctctttgtagatacaactccatgctcagtgttccattgcatgcttgcgctacctggtccatgcttgtgctacctggtcgaggctgcggactacatttcccaggcctcttgcaggtgggtggagccccataactgagttttaactcgtggatgctgttaggtgagatgtgcatcatcacctctagtgctggcccatgaaatttctcccacacatgctcctccttgctcctttcccttatagctgatagggatgacgtcccccacagtgaccttggaagccgcggttgaaggtggcagagtaactctcagtctgggtctgaatgtctccctggaggagagccagactactgatcgctaacagtcaccttggattattatgagccataaaacttccattacatttgaccctttatatgctttaaggcctgtttattacaattgcaattatttttgtttgtttgtttgtgtttgagacagagtcttgctctgttgcccaggctggagtgcagtggcacaatcatggctcactgcagccttgacctcccggactcaagccatcttcccacctcagcctcccaagtaactgtgactacaggcgcttgccaccacatcaggctaatttttgtattttttgtaaggacaggatttcactatgttccctatgctggtctcaatttcctgggctcaggtgatcctcctgccttggcctcccaaagtgctagggttacaggtgtgagccaccgtgcctgaccacgacggcaagtattaaccttaaccaaaaaaaaaaaaaaagaaaaaaaaaagcatattctatttatccatttcctagtgctagacactgttgctccaaactccttgaagcaatgccatgatgaacctcctcatacacatttccatatgcatctgtgagcaagcgttttcaggttatctaacagaaatggaatgcctgcgccatggggtttgtacatattttgtttacctgaccaaagcaatggcagagacattcaggtgtgtggggcagtgacagcagagatgttcatattcagctagccaaagtcagcatggctgcttggggtgggcaggctcaatggggctaccaaggggtcattgctagatcaaccccacagagtgctttgggcattgtttttggcacagcctttaaggctggccttctaagcatccttgagattctgtgagctcccatagctgttaataaaattagagcgagttctgttgcttacaattgcaaatccccttatttatgtatttatttatttagagacagggtcttacactgtagcccaggctggagtgcagtggcatgatcatggctcactgagacctcaaaactcctgggctcaaatgatcctcacacctcagcctcccaagtagctagtagctgattaaaaaaaaaaatgtgcagatgggggtctcactatgttgcccagactggtctcgaactcctaggctcaagccttagcctcctgagtagctaggactacaggcacgtgccaccatgcccagctaatttcatgttttgcagatacggggtttcactatgttgcccaggctggtcccaaactcttggcctcaagggatcctccacgcctcagcctccccaagggcttggattaccgatgggagccacttcaccaggtctgcaaatcccttttcatatgctagattcaggggaaggcaaacttcttctgcagagagccagaaagtaagtatttttggctttgcaagtcatacagtatcttctcagcttctcgattctgctgttgtagcaataaagcagccaaagacaataataatgaatgggtgtggctgtgttccaataaaactttatttataaaaacaatggcccacaagacataacttgttaatccctgagctagataaaaaagagacatctcctttctctaaatctctatgtagacatttatgccatgtttcttagtcttagctacttggtaaacgcttgttctcatccacacagaggggtcctcacacatggcctaacacattaccttgcctgaaatagactggatgaataaatgaatgagtgaatgaatgaatggccttaatttagaggtggtctcaatgaacaacccaggcagagaccaatcagaaccgcagccggctgtagacaacctgtgccacagaaccagcggagtacagagtatcattctttgtccttcagctgttgcatgaagactaccttcttcacaactaaccccccgcccaccctacctggctttatcccacatccctggtaggcatccatttaggggctcagtttctgaatttcagaagttaatgaggaacaagggcaactgtggggggttcagttcttaacagcaaactgttccagtgactaatccatctttcattcccagtatttttatttgtcccagcagaaatgtgtatgagtcacagctcctggataatttttttttaatgcatcattgcgtgtatatctctggcctgcagacctgcaaggtctgggtgctgttgacagggggctaatgatttcagcagcaacaacaaaagctgtcaagtcatgctaaccaggacttctttcccccatgcctatcagcatgaaagaaataaaaaaagaaaaaaaaatggacttagtgtctgattaagaatgtggcacatagagtgatttaggcggccacagacttatactttctcctaccaataactttccctttttttaagaccctgccacaaacacctcttctttcggaaagccttgattaatctaatctcaaagaccagctctcagagcagctctaaaaccactatgatttgcaaatcaaatctcaccctcttctgatctcatttctgtcttgcagtgtattcctgcagcctttgtgtagaaaattcctattctacccctttcaaataatttgtagcttgctttctggagtgtgaagtctcttccacgtgggtatattctctctctccagcgtggtgcagtgaaccgtgattgtgccactgaactccaggctgggcaacacagcaagacactgtctcaaaataaaaatctagtagccgtgtctccatccttatcatattcaattattcagtagcactcagcacagtgatttctctctccttcttaaaatatgctttttgcaccaaatcagacagagttgatttgggaattatgaagagatgaagccaaacatccacttggcccctcactggctatgtgacttcacttcttgggggccccagtttttgcatctataaatggggatgataatgatgataatcataataacagaataaaggtagataatgtttcctgagccactaatcataatatatgctcaatataaacaagggtttttcatctattttgctcattgctgtatggtcggggctagcacagagcctggcaccatttagataatcaacaaacattttttgaataaatgaattaatggattgtttcccatacttgcctaatcttaagatgcctcaccatcctcccaggaagagactccaaggtcaaccttgactctcgtattatctgtgtctagaattctaattcctcaaattgcttagtttccgtattactcaatgatcctaaagatgcaagtgacagaaatccaactcaaaccagttcagggaaaatacggaatatattgggtcatctaagcctgtctaacttcgggcatggctggatccaggtgctcaaagattgcttctttcccaagagtgtaactcagaaggctgtctctgattggtcaggattgggtcatgtgttcaatcactatgactctgaatggccaggcctgagtcatgtattttctactagaaaggaagggaggaatggtccccacaaggttaactggagccccagtactacaagaagagaaataaatgctggctaggcaataacaaagaattgagggaggctcctccagactcaccagtctacattccctcctgaacactctgccaggttaatgctataaagggcaaacatgatcaagttacttatccctgtgctcaagcaccttcactggctccctactgctgactaaagtaattatagtttgctcagcgtggcatggaaagtcctttgcaatatacctgtcttctccaggctgagggatcagtgagaaagctgttctaagaatccggacaagcaatggtgaggcatggagtttggacagcaagagtggggatgcagatgtggatttcagaaaaatccataatttcactgaaactgccttcatcaaggtcaaaaatttggactgccaagtccaaatctagtagctgtgacctggcatggtggctcatacctgtaatcccagcactttgggaggccaaggcaggaagattgcttgaggccaggagttcaagaccagcctgggcaacatattatctaaaaaattaatttaaaaaaagttagccaggcatggtggcatgcaacactagtcccagctacttgagaggctgaggtagaaacctcacttgagtctgggaggtcgaggctgcagtgaactgtgattgcaccactgcactccagcctgggcaacacagcaagaccctgtctcaaaaaaaaatctagtagctgtgtctccatccttatcatattcaattattcagtagcactcagcacagtgatatttctctccttcttaaaacatgctttttgcaggaaatatttgggataccctgtaccccccattcccttgcacggccatgttctactggccttctctggcagcagatatgtgctcagactctatcttctacacccattgaagacaccattggttgcaaaccagcaacattttccccttctccctattgaaaccccaagtttggccaccatatgcttctggagagaatgaaccctcctcacccccagcaggcagatcttaatgaaattcagccaatcatgaagaggcatgtgactcatttctaaccaataagacttgatggaaatctgctggaggcttcagggaaggtcttcttccctctcaaaacaagatacaggaaaggaaagtgacttgttctgctcttgtggcttgtggatgttgttgtgacagcacgatgtctaggggctatggcagccaacttggacccacgaacggagaccgtgccatcatggtagatggaaagatgcaaggaacctggatcctcaatgctgctcttgagccgaattacccaaccctgggactgtcctatctcaggacacattgcataaaacacattgggttcagtcttcatttacttatagcaaaagtcatcttgatggatatactgcttgtatggtaaaacttccagaaacatgactccagctataaccttctttctcacatcactccagacctacgtgggatgtttaatggacatcttcccaagcagtcctacaagcactttaaaaatgtgtcccaacttgaatcaattatctgccacattccccaaaagacttttattcactagataaatggcatcgccatctatgtgatttctctcatgagtgatcctcaagtcttttttccattcctttattcattcatgtaacgaactctcatttactaagctcctctatgcactgggcattatgcaagatgtaggggataacacagtgactaagacaaagttccatccctcgtgaagcttatatttccggttagagggagatattaaacaattaacccataactgacagcagctaagaaataaacaggatgttctcatagaaaaatacagggaggcacacacctagataaggtgatcaggggaggcttccataggcaggtaataaataagctgagatctaaatgcacagccaaaaccaactctgcaaagcatgagaagagttttctaggctgggcgcagtggctcacgctgtaatctcagcactttgggaggccaaggcaggaagattgcttggggccaggagtttgtgaccagcctgggcaacatgacgaaaagtgtctctacaacatacaaaaaaattagccaggtgtgatggtccatgcctttagtcccagctactctggaggctgaggtggaaggatcacttgagcccaggaggctgaggttgtaatgagccgtgactgtgccactacactccagcctgggtgacaaagcaagaccttgtttccaaaaaaaaaaaaaaaaaagagctttctaggcagaggaaatagcaagtgcaaaggccccaaggctggaccaaatttgagctttccagaagccgcgaggaggccagtgaggtggtaatgtggagacaggcagatccagcagggcctcaaaagtgatgtgtggattttatgctaagtgcagtgggcagccaggggaggaatttaaacaaggatgtaacatgatgtgactcaggtttttaaatggtctcacaggctattgcatggacgatggcccataataataaaaatgatcacagctaacactttgatagtagatactgtgtgccaggcattgttctaagcacattccgtatatattaactcattaagtcctcccaccgaccccatgaggtcagcaccataatcattcccattttattgatgaagaaactgaggcacagagaattacagaaacttgcctacggtcacatagccaataaatcaaagcctggcctagaggaaacaaggagactagctacaggctgtggtgcatgtccagaaagggggctgcaggcagtggggcttggattggcccaggggagaagtgcaagggaggatcccgcatataatttcacggcggagaggaaagaacttgcaggtggtcttatcctctgtccattctcactcctttctccagcaggtttttgaacttgacttctggcttggtggtctcccagcccaccttatattaatagatggggatgtcctcgctgtctcctcccccaccatcctgctgtctggcacctcgttcatctcacacaaccactccccttgaaaacagcccgaccctcctacagtacaacagtctccaccttggtcttgccctgcccactccacaccagagattaaaagccaggcagccgctcctggcggtcaaaggagagcactttgtagacgctccctggaccccagcaaaacttctattgtgttgctggagacagaaacaatgccagtggcccagttgctccccagccaaaggtggccccagcaaacagtctcccagccccatggatggggtgcctgggagtgttaacagagctccctcggggaccagagggccaggagagaagcaacatgtgcctgctggacactcccgtctacagccggctgcagcccccacccacccacgtgcctcactctaggcgaagaaaacccaaaagtaggagaggacaggccagagatggctgcttgacctttcaaggggaggcaggagtttctacaaagcctctgggagtcccctaagtatgtgttcctaccctccaggggctaggaggtcaccctctcagttcctcatcagcctgggataggttcagcggtgggtggaaaatatgaccagcaaggggcctacccacacccggggcctgctttggggctttcttaaaaagacagtgctaggatcccagaccaacaagacaccttgtgcaaagctctgtgctctaggctctcagagaataggaaagcaccctgtccttctgggtcagagtggagttaagatgagttatgcagaggcagagatttgggggagagatcaaggaatacttcatggaggagggggcctttgagagtgctctgaaaaaactgagaggattcctttctttgccctgccctccctcttccttctcttataaaaaaaaaaaaaaaaaaaacaaaccctccccaaatgactaataaataaaagacacacaaaagagacacatatgctttatctataatgtataggccgtgttgtttttgaaactcttttctgctctgtaaaggaatgtgtgtgcatcacggaaaccttggaaaacccagagcagcatatagaagaaaatgaaaattgcctctatttccaccatatagagataaaacactcttaacttgtcagagtattcctttccaggctttggtggtgttttttcatattattactaaggtgaaatttacttgcagtgaaatgcacatgtctggaatatatgactcaatgcattttgacaaatgtctacacccgtgtgtacacccttccaatcgagatctagaacattcccctcaccccagaaatttcccccgggtccccttccagtcagcccccatccttctgatttctataaattagttttgcctgccatgtaattggaatcatgtgctatgtgcttttttgtgtctggtttctttcactcaacataaacaatgtttttagatttctccacgtatcagtagcttgttctttttcattgttgagtagtgtcccattgtgtggataaatcacagtgtgttcatcctgcaagaatcttttgggttgtctccactttggggctattatgaaagagccacttataaatattggccaagtctgtgcatggatgtaggttttcatttttcctgagcaaatacttaggagtgggataactgagtcatatgattaacttttatgagaaattgtcaacagttttccaaagtggttgtaccattttatatttccaccagcactatatgagggttccaatttctcgatatcattacattttttcttttttttttttttgtttctttttgagacaagctctcgttctgttatccagtctggagtccagtggcacaattgtggctcactgcaccctcaacctttcaggctcaattgatcctcccacctcagcctcccgagtagctgagaccacaggtacacactaccacacccagctaatttttatattttttttgtagacagagcattttgccatgttgcccagactggtcttgaactcctggtctcaagcaatctgcccgcctcatcctcccaaagtgctaggattacagatgtgagccaccacacccggcctattattacttattaattacacaagtaatacatgagtatagtctcctgcaaggctaaaatacctttggataaccacctggcacccaccagtccccccagaataactaccatcagcagtttgggatgctgcttcgcagacgtttgcagaccttttcttgtacatttatatgtatagatatataacatttttagggggggtggttggagtctcgctctgtcgctcaggctggagttcagtggcgggatctcggctcactgcaacctccgcctctggcattcaaggaattctcctgcctcaccctcctgagtagctgggactacaggcacacaccactgtgctcagctaatttttgtgtttttagtagagacgggggtttcaccatattggtcaggctggtctcgaactcctgacctcaggtgatccacccacctcagcctcccaaagtgctgggattacaggcgtgagccaccatgcctggcctgatatattgactgtgccactgcactccagcctgggaaacagaggaagaccctgtctcaaaaaaaaaaaaaggaatgtttgtgcattgctaaaaccttggaaacccggagaagcatgtagaagaaaatgaaaatcacctccatttccaccatgtagcttaaacatccttaacatgtcagagtattcctctgttttctatagatatatatatacatatcactatatatgtgtgattatatatgtgtctccatagaaataaacaaaacaatactagaaacaaatacaatactagaaacagaacaatactatgtgtcttctatggatatatatatagtattgttttgtggtgactctttttacaaaaatcttgcattatatatttcttcattgtacttaccacccaggccgtattgtttgattccctgcctaggatgttagctcagctggggcagggaatttgttttgttcactgctagattcccagtgtccagcatagagtggctgctccatcaatatctgtggaatgaaaggatagtggacatattgttctgcaatttgctggcttcactctataaatataactcatagatctttccacatccacacttacagatctatttccctctgtaaactgccgcatagcatattctgtgatatgaatgtgcaaaatgtcttttacatccctctgtttgtaggttttagtaaaatcagccaaagggtcaggatttctaccaccacatacttcaaggagctcaacacattgcctacttggtggggagtgggggggaataatggtaaataggtagaatctttataatttggcaagtgagggtggtagtggggagaaaggtagcatcaaagttgtagtggggtggttatgctcactctggagccagatgttctgggttcatatcatgaccaccactgtcatgctgtgtgatcttgggcaagttactcaacttctctgtgcatcagttttccatctgaaagatgggaataataatagtaacctccaagggttgttatgagaattaaaagtctatagagcagcaatgagcacttgttaaatactctggtgttatctactgttattattcaacaaccaaagggtgtttgcctctaaggaacacatccagctcccttcagtcattttctctacctttctggcccgggtgggctctggctttcccatccactgagctagaacctttattgcagagtagagagtgacccggggcaagcggagggccgaggggaggaaacccagggaggagcagctttataggaaccaggagagaaaggagtttccagaagccagggctggtaaacagtgacaaaagctctagcagaggggtaacgatgtggacccagattaggcggttgcaatttggcagcagggaagtcaccggtgacctttgggagaaacgctggggcagaagccagcttcagagggacagggacagggacagggacagggcctgagctggggctggggagtcttccaggagctgccaactgctcttctgagaaacctggccaaattggaccatatcttgaaggagagagaaaatattttgtttttttttaaggataagaagctctgagcaggtttaagaggggaaacttatttcaagagccatgactacaggatctgagaggaggggagctgggactggaatgggagccaagagcccggcattttgatcccaacatttctgctgaatcttttcttccccgccatctccgtgcctctgcacctgccaacctccctgccaggagcacccttcctctgtctgcctggcaaactcctcttcatcttctaaattaggggttgacaaactctggccaccagccaaatccagccccccgccccctgcctgcttttgtacagcttgtgagctaagaatggttttcacattttaaatggctgggatggggggaatcaaaagaagactatttcgtgacacatgaacattatatgaaattcaaattttggcttccataaataaagttttattggcacacagccacactcctttgtttacctattgtctgtggctgctttcttgctacagtggcaaagtggaacagttgtgacagaccatgggtcctgcaaagtctgaaaaattccctatctggccttttacaggaaatgtttgctgatctctggtctaaatcgctacttgaggccgggcatggtggttcacgcctgtaatcccagcactttgggaggctgaagcgggcggatctcttgaggttaggagttcaagaccagcctggccaacatggtgaaaccccatctctactgaaaagacaaaaattacccaggcgtggtggcaggtgcttgtaatcccagctatgtgggaggctgaggcaggataattgcttgaacccaggaggtggaggttgcagtgagctgagatcacgccattgcactccagcatgggtgacggagcaagactccgtttaaaaataaataaaaataaataaataaataataaataaatctctacttgagatgaacaaaaactaccactgtctttctcagccttacctcctttgtgaccatcccttggtcctgtgagcccctttagcactgggaaccaagtcatagtatggcatggtgcacgctggttggctgtcacttgtttgttatgcatttgtccccgccttcctgaaggacctgaaccttgccctgtaggcttcaatcccccagcatggggacattgcctgatcgtccgtaaatattgatttaaatattttaaatatttaaatattgaagttcacccattcaccactctgagtctagttttctcatctgtgagagccttgaacttggtccctacgatctctaatagtctgtgggggaaggacagccaagacctcaccaggcagtatgggattatttgccaaaaatatttaaaaggacctttcgagaattccataagccacaaattcatagactgtgggccaggttttagcccaaacgtgttttgctgggtctgcacctatttttttttttaacttagatgtcaatggaaacctaacccagcccactttagtcaccagtactatctatctgcccctttcaggcatttgagtttgccattcctggatggagagttaaagaccattataaccatgtcacccaggaccccaaaaatggttctacagtcaaaggttaaggatatatttaggtcagttgttcctaaacctggtgaaatcaaatgactcaagcagtatataaaacacagatccctaggcccacccagacccaccgaaacctactctcccataggtcatggtgctggaggcggaatttttttcaagatcctcccaaaatgcttatccattatgggaatatgtattgaatcaatatctgcagatgtcaatttggctggacctgtcaaaattataaatgcacctatctcttgacctagcaattccatttctgggaatctgtcttctaaaccaatgctttttaaactttaatgtgcatacacaccccggtcatctttttaaaatgcagatcctgatggagcagatctgggttggagcctgtaatgctgcagttctaacaaagctcccatctgatgcccagctgatggtcctggaacattctgagtagcaaggccctagatctcccacacacacacccagtgatgtatgtacaagatgatgcattgtatcatagtatgtaattgcaagtatgggaaataacctaattgtccatcaataggggactagcccaataaattatggtgcatctcagaaaggaggagcattatacagccttgaaaagtatcaagtatcaaggcagtgctttaggtactggtatggaatgaactctagggcatattattttaaaagcaaggaggagaatagtgagtggagtgggtaaccacttatataaagagtgttggctgggtgggtatgtggggaatatttatatttatattcacttgtaaatgcacagaattgcctggtagaagacactagtaactggaaagggaaactgagtggatgggtgacagggaagggagggtgacattttactgtacccatttgaattttgaactacgtgaatatgatacctgtttaaaaataaacaaaaattttaaattataattatacataaatagaaagactcaccacatacttctaatgctcagacatgaatttagaccatcagaaaagctgagctgcaggtaacatggtggatgtattagtctattctcatgctgctatgaagaaatacccaagactgggtaatttataaagaaaagagatttaattgactcacagttctgcatggctgaggaagcctcaggaaacttacaatcatggctgaaggcacctcttcacagggcattaggagagagaatgagtgcaagcaggggaaatgccagaggcttatgcaaccatcagatctcagaagactccctcattatcacgagatagcatggggggaaccacccccatgattcaattacctccacctggtcctgcccttgacatgtggggattatggagattacaattcaaggtgggatttgggtggggacacagagccaaaccatatcagtaggataccttctgccttggtacaccatgcacacacacacatccaacgcacatgcacacatatgaacacacacacacttgcatacacctttaaggacagtcaatacagtgtgttgaaagcctgctgagcttaaactctgcaaacctcagttggatcccagctccaccagctgagtgacatcaagcaagacacttagcctcgatggggatgatcaaaatagtcctggctgccctgcagaccttgggtggtgagaaaactcttcataaactgtcaagcatacacatgaaaagactcattataatatgaacctggatgggtgagccagatggggcaatccacagccttctctccatggggtcccgtgcacacctctcaggacgtcactgcaaggtggaaacccaatcccttgacctttgcagtcaggcagctgctccgaacaacccctggcagtgctaatctccaactctcctctcaccatcgggtccagctgctgggctgagtcacacgcaggccgagggacaggcacatgacttgtgtgtggagctggtgtgagtgtagtggttgggggagggtagtaaagaccacaagaggtgattactccccacttagtaggaaatttcacctccaggggaggagatctaagcctgactctaggtcggaactcaagtggctgcctggcctgtctggcagaattcttcctccgggaagcccactggatgtgtatatgtgtgtgtgtgtctgacagagggaggggcagagtgtgtacaaaagaatgatactaaaaataactagccaggcacctgtggctcatgcctataatccctgctacttgggaggctgaggtgggaggatcacttgagcccaggagtttgagactacagtgagctatgattacaccactgcactccagcctgggcaacagagtgagacaccctctctaaaaaataaaaactaaaaaaaaccacatgtactaagcacttaccacatgccaacctctatcctgagcacctcgaagattaaactcattgaatctccattgatactggtatcaccatcaccattacgatcatcctcactttccagatgaagaggccgaggcccaaaacaggtaatgaattttaccaaggtcagtcatatagcccaggttcagagacagtctgattctagagcctccgctcttaacctctcagctacagggaatttcattccttgaagggggtttccagaggtcatttggcccagtgcagtgagtgagatgatggaaacagtcaaccatgtttgcacctggctgtgtgaccctgggcaaattgattacctcctgtgcttcacattttagagcctcactttcctcccctaaaatgaggatcatcacaaccatatccacctctcagggctgttttagggcttagtaataacatacttaaagtcctccacacaagaccttgttaatatgattatcataccgattattatccagtactagtgagcaaggtataaaaaatagctagaaaacccctaatcctgggcaagaaggaatcaaaatctccttcttaagcagtttgtccatatcattcatcagcaacatgtaaccaatacatcttgccttttcttcctgttgccgtcaacccttctaagaaagcaagatagggctagaaaagaaagtgcctatatcttggtcatcattttaaccactttattttttggttttggttttaataatcttgatttctgctgagagacgctcacaggagagagaccctgggtaccaagtccatcctggcggcagggggacagatgaaattcctctttcaaggttgcttccacttccacatccctgggagactcattcaatcctacagttatttagtgagcacagactctgttccagtcatctgttaggcactggggacacagcaccgaacaaggcagacaacattcttcagctcatggagctgacactccggcagaggagacagaaaataagtaagtaaagaggccaggctcagtggctcacgcctgtaatcccagcactttgggaggccaaggagggtggatcacttgaggtcaggagttcaagaccagcctggccaacatggcgaaaccccatctctactaaacctacaaaattagccggttgtggtggcatgtgcctgtaatcccagttactcaggaggctgaagcaggagaatcacttgaacccaggaggcggagattgttgcagtgagccaagatcataccactgtactccggcctgggcgatagagcgagagactctgtctcaaataaataaataaataagtaaagagatcatctaatgtttaagtttcaaaaaatgccatgaagaaaaataaaacagagtaaagggatggagagtgacgagggagcggctgttattttaaacaaggtgatcagagaaggcctcttggaaacatgacagaggagagctaatgaagtgtgtgtacctggggaaagagtattccaggtggagacagggagtggcaggtgcaatggccctgaggcagaacccagggagacagtggtagggcctaagtctggagcggcagacaaggccttgctgtctcctcctttcttctctgccaaactagggtgaggacagcggcctgctggcccacatccatcccagagttgctgggaggtaatggatgggaaattgctctgagaggctgcacagggtccagtaggagtgttattaatggatgcactggacgacgcccatgccaggggcactttaggacaaagtggtttcttctccctcctggtgagtccatgttatcctaaataccagcactgagagagcccaaacttcaaacattcccatcctctccttcaaggaatggaaacagcagggcctagagaaggcaggagaaccatccaaggccacgttgcaagttcctgccagagccccagtgtcaggatcaggctcaagactgaaaaaatactgaaccatcccattcccaggtgacaggagagtaagtaaaatcacttttcttttcttttcttcctaaaaggttgttacttcccctagggcaagagggggatgagactctttgccgggtggatgggctgggaaaaacaacagtttgcaaaacaaattaaatgtgttaaatggccagtttctcccaccagtgggtctctttgccctcagcaagtgacttctcaacttctcctttgtggttttcaaaacattcccctaaatttctttttttgttttgttttgtgacagtcttgctttatcacccaggttggaatgcagtagcatgatctcggttcactgcatcctctgcctcccaggttcaagcaattctcctgcctcagcctcccgagtagctgggattacaggtgcatgccaccatgcccggctaatttttgtattttagtagagacagggtttcaccatgttggccaggctggtctcgaactcccaacgtcaggtgatccacactcctcggcctccccaagggctgagattataggcatgaggcacggtgcccagcctacccctaaatttcttaggtccttgccacccatggtgtataagagtcagagaagatattgggctctttggcccctttccacagatgaggaaactgaggcccagagtagggaaacacacctcatctgagacacttgggctccacagttaggagctgaccttctctctaaaagaagtgactataaaccggtataagataacataatgagaaaggtaatttcagaggatgccaagagctatggatgaaataaaccagagggcttggccgggcacagtggctcatgcctgtaatcccagccctttgagatgccatggcgggggaatcacttgagcccaggagtttgaacctgcaatgagctatgatcacaccactgcactccagcctgggagacagttttttaaaaaaaccagccttgagctcaggagtttgagaccagcctgggcaaatagcgaaaccctcgcctcatctttacaaaaaattcaaaaattaacagagcatggtggtgcatgcctgtggtcccaattactcgggaggctgaggtggcaggatcacttgaaccaagaaggttgaggttgcagtgagctgtgatttcgccactgcactccagcctgggtgacagagtaagaccctgtgtcaaaacaaaacaaaaaaaggtaggattggcaggactactttagtggtggtcagtgaagggtcccgggggagtttgcatatgagctggtcctgtagcttgagcaacaagcagccatgcccagagccaggtaaaaggggggtctgggccaaggggtggcaaatgcaaaggccctgtggcgggggcaagcttggccttggagcagcaaaaaggaaagtccagtggggctggagcagagcagagcagacctggggagggtacgggccgatggcagcggcaggggccatgtctcaggccttcccggccactgtaagaaatgtggatttaatcctaagggcagtggctgccagtcgaggcctccatggttggtgggagagctgggccttaaaacctggatctcattcttcagagccaaggctcacaggcctgcaactccccttggccttctatgtatcccaagacttcctctgtcaaccctggaacttcctggttatactccgggcatgtgactctgtctcgtccgccttgggctgtcaagtgactcccacagccctgatttcccacaaactcactcagcatcaatctcctctcacacacaggcagatattctcctcggcttctgcaggtcacactctctgggagccttgccccagcaaatgaatttgcatctgcccccaatcctcaacagcagcagaaattggggatggggaaaaggagagaacagagagacctttcaggagcgaatcagtctgcaaactggataggaaggcagagagaacacaggccagacccaacctggggagcttatcagctctgtcctggggtgtaggctcccagaggtctgagctgtctcctctggcctcactcctgtgttaagaggtgacagacaggatcccagggtgagtctggctgaaaatagacaggcagcaggggcagccattagtggtcccttgtgaggttctaactctctaccatcaaatcaccatcagaccaccttctttggtgttatctttctttaatgtaggcagctgaagtcctgatattaacaataataattcacttttattgagcacttaatgtgtgctactcactgtactgcgtactttattttatttttattttattttattttattattttatttagagatagggtctagctttgtcaccgaggctggagtggggtggtggaatcatagctcactgcaacctccaactctttggctcaagtgatcctcccatctcagcctcccgagtagctaggactacaggcatgtgccaccctgcccagctcattatttttttaaattttttgtagaggcaagatcttgccatgttgcccaggctgattttgaactcctgacctcaagcgatcctcctgcctcaaactcccaaagtgctaggattacaggtgggagccacagcacttgggccagtactttagaattttaactcatttatacatctatgtcaaacggaaacaaaaagattcttagaaaacttggtgattcctgtgaattttaacaggctggctaccttgtaacaataccagaaacagaaccagtgagtttgtctgccaacactgctttaatacaaacccagtcacccaccccataagtcccacaaaatgccccatgaagattctcccatgtgactattctggagccacccttcaggaagaacttccagacacaaatcagggagcccctgcctcacctcacacctgtcaggatgactactatcaaaaagtaaaacaaaacaaaacaaatatacacagaaaataacaagtgttgggtgaggatgtgggaaaaatttgaacctgtatgcattactggtaggaatgtaaaatggtacagctgctgtagaccacagaatggcagttcctcaaaaaattaaaattaggattaccatatgacccagcaattccacttctgggtatataaccaaaagaatggaaagcaaggtcttgaccgggcatggtagctcatgcctgtaatcccagcactttgggaggccgaggtggacagaccacctgaggtcaggagtttgagaccagcctggccaacatggcgaaaccctgtctctactaaaaatacaaaaattggccaggcatggtggcgcatgcttgtaatcccagctacttaagaggctgaggcaggagaatggcttgaacatgggaggtggaggttgcagtgagctgagattgcaccactgcactccagcctgggcaacagagtgtgactctgtctcaaaaaacaaaaaaaagaaaagaaaagaaaccaaggtcttgaacagatatttgtgcaacagtgttcatagcagcattattcacaatagccaaaagctggaagcaatgcaagtgtccaaccacagatgaatagattaaccaagtgtggcatctacatgcagtgaaatagattccaaccttaaaaatgaaggacattctgatacatgctacaacatgggtgaaccttgaggatattatgctaatgaaacaagccagtcaccaaaagacaaatactatacaattacactgagatgaggtccctagagtagtcaaaatcatagagacagaaggtagaatggcagttgccaggggcagaagggcagaatggggagttgtttaatgggcatggagttcggctttgcaagatgaaaagaattctggagctggacggtggcgaaggttgcacaacaatgtggatgtacttaacgcgtctgaactgtacatttagaaatagttaagatgttacattttatgttatgcgtattttaccacaactaaaaattccttaaaaggccaggtgccacgtctgtaattccagcactttgggaccccgaggcgggtggatcatgaggtcaggagatcgagaccatcctggctaacatggtgaaaccccgtctctaataaaaatgcaaaaaattagccaggtgtggtggcacgtgccagtagcctactcaggaagctgaagcaggagagtcgcttgaacccaggaggtggaggttgcagtgagccgagatcgcaccactgcactctggctgggcgacaaagtgagactctgcctcaaaaaaaaaaaaaaaggccagacgcagtggctcatgtctgcaatcctagcactttgggaggccgaggtgggaggattgcttgagggcaggagtttgaaaccatcctggtcaacatagtcaaaccatgtctctacaaaagaaaataaaagaaaaaaaattgtagtaagaacaaataagatggccctgcctccttcctggggcccagaaagagatctcactttctgacgggaaggaaagggcccccagcagcattgcagtcacacccagctccttctatagatgttaatagcctggagcagatctttgtgaccccaaaataagccatctcagactttcagtgacactctttagccccagaacagcatcacagtgaaaggagaggtcgagagaaatggagctggagttctaacattgactttggggaaccttaaacaattcactccacctccctggacctcagtttcccaatctttccaagtgaggaggctggacttcgcaagttgtccaggaattatatctgaccccagacatgtcttgttcggccatcacaagatttaaaagctgagagatatcccattagaaggtccggccacccgggggctatgtttttccgaggtcaccatagtctggaagtgcactgtctggaagggttcccccttggatggggctagtgctcctcagttccacccctgccacaggcacaaaacttccctgccaggaccttgcaggcagctgagtttgcaaagcctggacaaaatgacagtggagggacctcacacttcagtgacagctggttcagggttttgtgggtgaagatttcttctaaaacacaatttaggggttttccatcatgggacacactatctctgagactctccttttttaactccaaccctggattcctcggaccagtttcccaaatagggggacctcacaagaggctctgcaagccccactggcaccccacaacttgactccctctcaatttgttgggattcccagcaggaaaggaagtctccaggcctgcttgcggggcttccaaacaataacctccctcttgcctcccctcgaaaaatagagaaaatgaaaaagcaggccaggcgcggtggctcacacctgtaatcccagcactgcaagaggctaaggtgggcagatcacctgaggtcaggagtttgagaccagcctgaccaacatggcaaaaccctgtctctactaaaaatacaaaagttagacaagcttggtggcacacacctgtagtcccagctactctggaggctgaggcagtagaattgcttgaacccaggaggcgaggttccagtgagccgagactgccccactgcactctggcctgggcgacagagcgagactctgtctcaacaaaagaaaaaataaaataaaataaaaaagcaaaaaccaaaaaggctcttattaaaacgattcttcatgacaacccagacaggaaagacaggaactgacatcatcatcccttgaactcctcctcaccataatttgatactaataaaggatagcttttattgagcatttactgtgtgccatgccttcttctaagcaccatgcatattatttcattgaatcctcataacaatccaaggagataggcactattataacccattttacagagaagaaaactgaggcagaacctgcacattggtggtgagaaggcctgtaaaagactttagctttctcatctctcatcacgtgaccttggacaagccacttcccctctccaggcttcaatctctaagttgtacaaggtgatcattctggtctaaacagtttgttactccttgaactcttttactaaaaatcaaagcacacattaaaaaaaaagaatgaaaaattggaaacaacactgcctgtatagggggtatatgtgtgtgtttgaagagccaactagtgaaactttaaaagctaaaaaagcctaaaaaaaaaaatatatatatatatatatatatactaataaacgttattttttttttttggagacagggcctcactgtgttgcccaggctggagcacagtggtgcaatcacagctcactgcagcctcaaacttctaggctcaaacgatcctcccacctcagcctcctgagtagcagctgggactataggcatacaccaccacatccaactcattttttattttttctttgtagagatggggtcacaccaggttgcctgggctgatctcaaactcctgacctcaagtgatcctcccacctcagcctcccaaagtgctaggattataggcgtaagccactgtgcttagcctagactttattttttcagagaattttatgtttacagaaaaattgaaaggaaagtacagagagttcccttatactccctctctccctcccctacttttccccattattaacaccttgtattagtgcagtacatttgttacaattgatgagctgatatgggtacattattattaactaaggcccatagtttatattagagttgactgtgttatgcagtctgcaggtcttggcaaatgtatgacatgcatccaccattaccttattaggtagaatagtttcactgccctaaaattctcctgtgcttcaccttttcatccctccccgctccttctccacaaacccctggcaaccacagttttgtggggtttttttgttttttttttttctttctctatagttttggtttatccagaatgtcatatagttggagccatatggtgtgtagacttttcatattgtctttttttttttttttttttttgacacagtctcgctctgtcgcccaggctgggatgcagtggcatgatcttggctcactgcagcctccgcctcccaggttcaagtcattctcctacctcagcctcctgagtagctgggactacaggcacacaccaccacgcctggctaatttttgtatttttagtagagatggggttttcttggccaggctggtctcaaactcctgacctcaggtgatctgcctgccttggcttcccaaagtgctgagattacaggcatgagccactgtgcccagcccatattgtcttatttcacttagcaatacacatttaagattcttccatgtcttttcatggcttgatagatctttttttctaatcaatgaataatattcctttgtctggacgtgccacagtttgctttttcattcaactattgaaggatatcttgattgcttccacgttttggcaattatgaacaaaggcttatacattttttatagtttttcttgccattggaaaaagcaatgacacatgatcactgcagattaggaaaatacaagaggacgcagagaatgaaatttcgatctttcatttcacaaagaaagaaactgaggctaagggagaggaaatgacaagttctccttgttcattcattcatgccttcacttattcctccagtgaatatttacagaggacctattatgttcaggcactgtgctgggacaggagacaccactgggaacaagagagatgtccgttactggggttaatattccagacagacaataaccaagtaaataaatgaatcatatttgtaacgaaatcacagctaatatttattgtgtgctttctttgtgccaaatgttgttcaaaaaactttgtgtactttatgacatttggtcttcacaagcacactgggaagtaagcctgttatctcaattttgcagatgagaaaagtatagttcagagaggtgaaatcatgaacctgaggtcacatcgctcatcgaagtcaggggagcaagatttaaacccaggtcatggctctcccgtctatgcacttaaccactgctctaaaatatgggaagatcatttcagatggagggttagggacagagcccagctgaaccctgaccttcaccttcttacgcctttgtgtcgggcactttgtttttcatggttctgagaagccaaacttcattgttcttcgtgggttcttccagttgcttagctgtggtccctgtggaccagggggaagggcttggagctcatggctggccagggccctgtgtgcaatcagatcacctttatttttaagccattaaatccctggtgacacatgctgctcttcagaggagcaggctgacctgaccaggagaacagagtcactgggcagggagaagccacacacctcaggcaaagtttttgacaatcaggcaaggaggcagggttggggggggtcttacccaaccctgcttcctgtgggatcattcaaatcagtagcagaaaaagccataagcttataaaatggtactggggagtctctgggggaaacaggtactcccatacacccctggggagtggaaggtgccagagcagttttctaaaacaattgtcatcaactaccaagttttacaggaacacagcctttggccagcagtttcaggtctaggggttcatcgtacagatatcttcgcacatgtgtaaaatgaagtatgtgcaatgctacgcttgacagaaatttgtagaaagaactggaatgacccctttcttctcctaccccccacacaggtccctggttaaagaaaccaggtccgtgcttgcaaagaaatctttggcagctgttcaaaggaagacgggtctccatgtattgcaattgagccctcttcagcataaactgttaagggtgaaaaagaaaggttcagaacattatatgctatcctgattgttacaaaagaaacaaaaagaggtgggcaggggctctgtctatagaggtgttgaactgggagttcctccacaagagcttttagcatcctgaggcctggcatcccagtattggccctcccttgctgtgcaatgaagatcgaagtttcaacctctctgtgctccagtttccttaactgtaaaattggacttgttggaaaaattaaataaagtcatctacacaagaggcatttctcaatgcctaggacgtaggaaatggtcaataaggaacagctgtataataattattgtgcacaaactctccctggaagaaggcacaaaaacatggataatgggctattacctctgggcactgggaaaactgggagacgggacaaggggtgaccaatttttcagtgtatgcccttttcgaagtgttaaactttttttttttttttttgagacaggatctcactctgttgccctgctggagtgcaatggtgagatcgtaactcactaaagcctcaacttcctcggctcaagcaatcctctcacctcagcctcctgagaagctgggactacaagtgtgtgccaccatacctggctaattattaaagtttttgtagagacaagatcttctccttgtgttgcccaggctggtctcaaactcctggcctcaagggatcctctggctaaacttttaattttttactttgtgcatgttttaatgttttttaaaaaatattatttaaaatagggtagcaggtccaaatcaaaatgagaaggagcaggtaagcgattttcaggccattttccagatggattttttgagctaacagcaacctgggtcctgtggctcaaggcctggctgctcatgggcattgtctgggaaactgttagaaatgcagaactccagcccaggaccactggagcagaatgtgtgttaacaagctgtccaggtgagccacaggcaggcgcaagttggagaggcagtggtctgaggactgcagtcatagaggacaccaaagtttctcagttttttgactcagctcagccagaggataaatgggatgggttgcccctcccatggggcgagggttggggagaagagagaacagcaagaattaagaactgcttggccaggcacagtggctcacacctgtaatcctagcactttggaaggcagaggtgggcgggtcgcttgagtctgggcgctagagaccagcctgggcaacatggcaaaaatccatctctacccccaaaaatataaaattagccaagtatggtggcacttgcctatggtcctagctacttaggaggctaaggtgggaggatcacttgagcctgggaggtggaggttgcagttagccgagatcaccccactgcactccagcctgggaaacagagggagatcctatctcaaaaaaaaagaatcgcttgctcttcctccataagaggttgtagcacatgagttctaaggtgtgtgacttttagcagctccccacttagggtttaaaataactttctggttgaaattttaaaaaaggaaagtaaggaaggaagaaaagggaacctcccactgcagcccacacaaccccaacaagaaaaggaggcctcctgctccccagcccagcctcaagcccacttaatctctctttggagacaggaacagaggaattgttcaaggagaaatcaagtgggaagctcttggagctgaagagcctgcaagccaatccacttcaagtttctcatgtaacaggtgggaaaatagaggcttggagaggggacatggtttgtccaaggccacccagcaagttaggggcagaagcagtgccagaatcatagaggcaggagagaccttgaaagcacctaccccagagttacaccttcgagggccccccagggaatgtctagaagaggcacagatcagctattccctctccactggccacaggccaggcacctgagccaagctgggcggatgagaatccatcctagaacttttgttggtcaaaggagtcatccatctttgcatctctccacaggtgtagagtctgccactttttaaaaataattgtatataaaattagctgggtgtggtggcatgcacctgtaatcccagttacttgagaggctgaggcaggagaatcgcttgagaggctgaggcaggagaatcgcttgagaggctgaggcaggagaatcacttgaaccggggaggtggaggttgcagtgagccaagattgtgccactgcactcctgcctgggtgacagagtgagactctgtctcaaacaaacaaacaaacaaataaataaataaaacaattgtgtacaatacacataacctaaaatttaccatcttaaccttttttttttttttttcctgtacagatggagtctcaccatattgcccaggctggtctggaagtccttgcctcaagtgatcctaccaccttggcctcccaaagtgctgggattgcaggcgtgagccactgtgccactcattaacctgtttgaagtgtacagtttagtagtgttcagtacattctcactgtcatgcaacaaatttgctacttttgacagacatgaatataagtttcttgaaacacttcttatactcctgtctaagaaaaacaacagtgaacaaagtgataaatggtaacagacactggtgcttggagccagggagacaagagggagtggtggaagctatggcaaacaggaaaacccaaaccccttctaggagacagtcactaatcagctccaatctgcttttgcctgcaggaatgctacatcatctatacaggaaaacacttaattttttttttttgagacagagtttcgctcttgttacccaagctggagtgcaatggcatgatctcggctcactgcaacctccgcctcccaggttcaagtgattctcctgcctcagcctccaaatccaaagtagctgggattacaggtgtgtgtcaccacacctagctaattttttgtgtgtatttttagtagagacagggtttcaacatgttggtcaggctggtctcaaactcctgacctcaagtgatccaactgcctcagcctcccaaagtaagaaaaacctgatttttttaacttttcttttcaaaactcaaaattcaaaacagttgaaaaggtacagaaaatgtctccctcctactacagtttcccactccacaggtaaccacaattactgatttattgtggataaagtgtctttataattatacaaacaaatagtaacataaacataccttttttccgtgttttatcccattttacataaaagagagcataacaaacacattgttttacaccgtgctttttaattaaataatctatcctaaagaatctttttttttcttttttttctttgagacagagttttgcgctatcacccaggctggagtgcagtggcacaaacagagctcattgcagcctcgacctcttgggttcaagcaatcctctcacctcagcctcccaagtagctgggactacaggcacgtgccaccatgcctggctaatttttttatttgtagagatgggggtctcactatgtcactcaggctggtctcaaactgctgggctcaagtgatcctcctgccttgacctcctaaaatgctggaattacaggtgtgagccaccatacccagccaagaatcttctttattagtacatagactatatgtatcctcattatttttacagttgcacagctgtattccaccatacggatgatctatttttttgcagtgtttttttgttttgttttgtttttgttgttttgtttttttttttagacggggtctcactctgttgcccaggctggagtgcagtggtgtgattatggctcattgcagtctcaaactcctgggctcaagctgtcctcctgctttggcctcccaaagtgctgggattacaggcatgagctaccttgactggttggatgacccatatttgatttaacccacccccatttagattgtttttctagactgttgcattttaaacaatgctgcataggtattgatagtgctgagcactatttacaatagcaaaggcatggaaccaacccaaatgtccatcaatgatagataggataaagaaaaggtggtacatatacaccatggaatactatgcagccataaaaaagaataagatcatgtcctttgcagggacatggatgaagctggaagctatcatcctcagcaaagtaacacaggaacagaaaaccaaacactgcatgttctcactcataagtgggagttgaacaacaagaacacatggatacaggaggggaacaacacataccagggccttttgggagttgcagggtaagcggggagagagcattaggacaaacacctaatgcacgctgggcttaaaacctaaatgacaggttgataggtgcagcaaaccaccatggcacatgtatacctatgtaacaaacctgcaaactctgcacatgtatcccagaacttaacgtaaaattaaaaagtaaaataaaataaacaatgctgcctgaataacctcctacatatatatttttcacatatgcaaatgtatctgtaactaaattctccaaattagaatttctgtatgtgcatttctaatatgtaaggaatttgcctacttgtcccctcatagtggttgtaccaagatccattcctgcagccatgtatgagggactatttttttcacaattacacaccttattgttttaatactgatttaaaaaactaaaacaaaacaaaataaaaataatgtgcgatacaaacaaacatgccagtgggccacatcaagccagcaggccccaactttcccaactccaactcttcaaagcccagaatgttgagtgactcgcctcaagttgcccaggacttgaatctgcactgtctgatttctatggctgcacctgatccgcttcccagctgactactaacttctgggatccctcaactttggcagtgagaaactgtggcttctgcaaagtcacgtggagcctttgtccgttcaaaaagttgaaaaagttccaatcttacttgagggtggtgactgtggatggggctgccccacatccaccaagtgccctgctctcagatgtcagcttgtgttgtgtaacaaccaaccgtaaaaatcatatttaggcagggcacagtggctcacgcctgtaatcccagcactttgggaggccaaagcaggcaggtcacttgaggtcaggaattcgagacctacctgggtaacatggcaaaaccctgtctctactatgaaaaatacaaaaattagctgggtgcagtggcaggtgcctgtaatcccagctactcaagagactgaagcatgataatcacttgaacccgggaggcagaggttgcaacaagatgagattgtggcactgcactccagcctgggcaacagagtgagactccatctcaaaaaaaaaaaaaaaaaaaaaaaaaaaaccatatttacttctgttcttttatccaagtgcttgaggaagcttaggattcagacagacttggagcgtcagtcctggctcaacctcctgcaagctgtatgattttgggtaatttacttgtccctcctaagcttcagttttcttaactataatatggagataataatagtctatattgtgaattgtgcttggtaatcacaccagacacaaaatatatacctttaaacattagagtcaggtccagctcaccaaaatactcaggctatgaaaggctgacaagattcagggcacctcggccgggcgtggtggttcacgcctgtaatcccagcactttgggaggccaaagcaggcaggtcacttgaggtcaggaattcgagacctacctgggtaacatggcaaaaccctgtctctactatgaaaaatacaaaaattagctgggtgcagtggcaggtgcctgtaatcccagctactcaagagactgaagcatgataatcacttgaacccgggaggcagaggttgcaacaagatgagattgtggcactgcactccagcctgggcaacagagtgagactccatctcaaaaaaaaaaaaaaaaaaaaaaaaaaaaccatatttacttctgttcttttatccaagtgcttgaggaagcttaggattcagacagacttggagcgtcagtcctggctcaacctcctgcaagctgtatgattttgggtaatttacttgtccctcctaagcttcagttttcttaactataatatggagataataatagtctatattgtgaattgtgcttggtaatcacaccagacacaaaatatatacctttaaacattagagtcaggtccagctcaccaaaatactcaggctatgaaaggctgacaagattcagggcacctcggccgggcgtggtggttcacgcctgtaatcccagcactttgggaggctgaggcgggcggatcacgaggtcaggagatcgagaccatcctggctaacatggtgaaaccccgtctctactaaaaatacaaaaaactagccgggcgtggtggcgggcacctgtagtcccagctactcgggaggctgaggcaggagaatggcgtgaacctgggagacggagcttgcagtgagccgagatcatgccactgcactccagcctgggtggcagagcaagactctgtctcaaaaaaaaaaaaaaaaagattcagggtacctctctcacttgttctcctccgtgacataccttcactgagacaagagcagtgggcagaatcatccacatgcgtcacaccatgttgtggttttttttcactgagcacatagagttggatacgtataagttgaatatacatgtaaagcaattcctttctatatttgcagtgtttgtgcaactagattgtacactccttgaaggaaggaattgtcttccagttggcaagacaggcttgagatcaactaagtattttacaagacagaacaagataagtggccgggatcggcagctcatgcctgtaatctcagcacttggggaggccgaggcaggcagatcactagaggtcaggagttcaagagcagcctggctaacatggtgaaaccccatctatactaaaaaatataaaaaattagccgggtatggtgccaggcacctgtaattccaactattcaggaggctgaggcaggagaatcacttgaatctgggaggcagaggttgcagtgagccgagatcgtgtcattgcactccagcctgggcaacagagcgagactctgtctcaataaacaaataaataaataaataaataacaaaataagcaatgggtacaaagtgccatgaggaaggacaacctgttcaaacagagccccggaagtatttccggaggctcctgagtcagccctttcaggagggtaagaggatgaaagaggaagtaacatttactcaacagcaatttgctgggcactctgtttcctgattttatttttttctgtttaattttttttctcttttcaaaataacaccatgtaccagtcagctttggctacataacaaactctcatttatttcttgctcatggatctgtggattttctgaggagatgctgttggtctcatgagctcagctgggcctctggccattggactcagctctgatctaccctgcgtgtcactcatcctttgggacttgtgggctactcagggcatgttctcagtatcatgaaagccaggcacacaagggaaaagttcacctccactgtacatttcaaacctttgtttggttcatgtccactgccatctcagtggccaaagcaagtcacatggccaagactaaagatgagatggagaagtccattcattccagggaaatggaagaggaaaagggaaatgtttgctctacggcagtctaatctacagcaacaagtaatacaggagtgcagtcttattaaaaattcaagcaagaggccgggtgcagtggctcactcctgtaatcccagcactttgggaggccaagacgggcaggtcacctgaggtcaggagttcaagaccggcctggccaacatggtgaaacccagtctctagtaaaaatacaaaaaaaaaaaaaaaaaaaagccggtatggtggcgggcgcctataatcccagctacttgggaggctgaggcaggagaatagcttgaaccctggaggtggaggttgcagtgagctgagattgtgccacttcactctagcctggatgacaatagcgagactctgtctcaaaaaaaataaataaataaaaattaaaaaaataaaaattcaagcaagaaaatataaaagcacaacaacagcggaaaatacgtcaccatgctcctcatcccaccatcttccccctactccctagaggtaaacacttttcccaggcgtttacacacagagaaagctattttgcccccttggtgccgagacagtcttgctctgtcacccaggctggattacagtggggcaatcgcagcccactgcagcctctacctcctgggctcaagcaatcctcccatctcagcctcccgagtagctgggactacaggcatgctaccacacccaggtcagaaacgtttacttaatacaatgagatcattctacatgtatttgtacctgacaattataagcatctagtcatgtaattattatatggactctacaattaggcatttggggtcaccattttataaatgaggaatctggggttaaaatgcttatccaagatcacccacctcttacatagctgaaccagaattcgaacccacgactttccaaaaattcttttgatttacagtgagctgcctctataaaagcacaagaggttgcaccacaaaacctgttgttatcagccccctacatttatcctttgggaccacagaggaggggtgtccgtgtgtgtgtgtgtgtgtgtgtgtgtgtgtgtgtgtgtgtgtgtgtgtagggggtgggtggtgtcgtgtgatttaggagagtgttcactatgactagcgttgtggcgggagtttgggagacatgatgaagaggaggaaagaccttcaccctcaggtcacttacaattaagccaaagaaaccaggagcctctcttgaagcagtttaataagatggcaggatgtggccaggcatggtggctcccacctgtaatcccagcactttgggaggctaaggcaggcagatgacttgaggtcaggagtttgagaccagcctgaccaacatggtaaaacccggtctctactaaaaatacaaaaattagctgggcatggtgacacacggctatagtcccagctacgggggaggctgaggcaggaggatcacttgaacccaggaggtggaggttgtagtgagccgagatcacaccactgcactccaccctgggcaacgggagtgaaactgtgtctcaaaaaaaaaaaaagaaagaaaagaaaagatggtgggatgtgctagtgtaagccttgggtacccatggggagttttattatctgtctgtctcaaagctgtcccttgacagagagctcagccagaagctagtatccctgatcagagtttggggaggacacaggtcttagccatcttcccagaaaatgggtaagactgagcgaaaggagaaagaacgtactctcacatgaagtgggaacagtgacaaatactacagtcttcagcagcatccggtgtgacatgagtgtgcgctcagggggcttcattcagactgggtgtcagggaaggtttcttggggaatgaacattccagccaaaacctgaaggccaagtgggaagcagctgaagaacaagggaagagagatccccgcagagggaacggcgggtgcgaaagcattgaagctggagagggctgggcattgtagacacagaaaggagggcagcagggtaaggatgactgtgaggaggaaaggagaaggctgagcagctggcagacgctgggctgtgcagggacttgagctaagctgtttagggaaaggtgtgacatgaccacaagctggtgccagagtgaccacagaagagtggcttcctgggcatctaagagggcacagtcagggcggtaagtggcttagaagcagggccgcgatcagtattgtgtacgttgtgtgatgactctggaggggactgaatctgggtatgcagctaaacattcaagttctcaaaagcgtgtttcaaatagcaaaactggagaagccctttaatggagtttgaaaaaggcacaggagagaagtctgacgtgtttcagtgcagggtaagggaagaagtggggagggattgggtttggagggtgtcacgaggcgacaggtgagccgaacaaataggacattgctaagcaaggctgggaagaaagggacgacgggcagaaggcacagcaaaggccaaggcggggtgtttggaacatgcccagctggtgtggagaagagactgggaaggattcaagctcaggctcctggaggagaaaggcataggggaatgctggaccgttcacctgggggttggttatgcagagcctccgatgcctgacatgggaacgagggagtggcctgatcagatggttcgtaataacttggcagattcacctcctgtgctctctcaccccaagggacttgagtgagtcattggggcccttcctcctctccctccacacaaacacacgacttttggggaggccaaggtggcagatgggggtgatagatcctgtaatcctatccccagtccaggggtcaggaagttctttccccagcaggctcccacccaagactgctgttaagactgaggttggagaagtgtttttctcatccacccagcctcaggtgggcaggacgggagccaaccagagccctctggagacagttctgtctgtgggatccgccctttggaggacacaaatgaaacccaatgcaacataaaagatggcaagaggtggccaagtgcttatcttatcaaacaaactgctccttggaaccaaagaaagggaatagagctttgcttgttttctctttttatcttcctgattaattgccagcaaggggtctgtgggatgggtggtggttgagggcgactcttggatgtgtgatctcgcctgggaggcaggtaggtttcccagtcaccctggatttttaacattttcttgttggaagtcacatcctcaagcaaactcttaggcactatttagggagcactccccaaacagctccattatggcctaaatattcttgggaagatgaaaaggggaaaagactatcattgctcaaaacaagtctataatctagatggaagcaggtaaagaggcacaatatttaccatcttttatttttacagggtctttatctatttccatcacttaaccatgagctctttgggaaccagaacccagtcagaaccattggggtatctgaatctggacccaagcatgtagtggggctcagtctacctgtcacctcattcaggattctttcagttgtaagtattagcaactcagctcaaaaaggcttcattgaaaagtatgatatataggccgggcgcaatggctcacacctgtgatcccaacactttgggaggctgagacgggtggatcacctgaggtcaggagttcaagaccagcctgaccaacatggtgaaaccccctctctactaaaaatacaaaattagccaggcgtggtgattcacatgcctataatctcagctactcaggaggctgaggcaggagaattgcttgaacccagaaggtggaggttgcagtgagccaagatcgtgccattgcactccagcctggtcaacaagagcgaaactccatctcaaaaaaaaaaaaagaaagaaaaaaaagtatgatatattaactcacggaatagagaaatccaggtctagaatgacttcaggcatggatagatctaggagtcaaagaacatcaccaagatcagactttcttttccctcagcacttttttctgcactctttgtgccagcctcagttagattctaactcagtggtggctctcagtggcaaaatagcttagcaacaccagttgggtttcttttctcccaatagtaatagaaatgcttaaactggctctagctggatcagtgtgggtcacatgctgatctctgatacaatcactgggcagggaaatgggctacactgattggcctggtgtaggccccatgtccatttcatatttgttacattaataaatacgaaagattagagacagcaataaaacattttacatttgaacaatagagcaactagagtgatcctttttaaaacctacaacaaatcatttgactcctctgctctaaaagctcctcactcagaacaaaagcccaagttcttcagaacaaaagcccaagttctgagccaggcgtggtggctcacgcctataatcccagcactttgggaggctgaggcgggcggatcacctgagatcaggagtttgagaccagcctggccaacatggcgaagctccatctctactaaaaatacaaaaattagccgggcatggtggtgtatgcctataatcccagctacttggaaggctgaggcaggataatcgcttgaacccaggaagcggaggttgcagtgagctcagatcacaccactgcactccagcctgggcaacagagtgagactctgtctcacacacaaaaaaagcccaagttcttacaatagcccacaaggccctacccaacatgcaccctgccccaaccccagttattcactgacctcctagtctccccttcgttcactctgctccagccaggctgctctccttgcatagccacaaaaagtatacatgcagtagcctcattttctttgctaataaaatgagacctcttctagtagacacctgatactttgcccagaattcccctttttctttttttttgagatggagtctcactctgttgcctaggctggagtgcagtggcacgatctcggctcactgaaacctccacctccctggttcaaacgattctcctgcctcagcctcccgagtagctgggattacaggcacgtgccaccacacccagttaattttttgtatttttagtagtgatgggtttcactgtgttagccaggatggtcttgatctactgaccttgtgatccatccgcctcagcctcccaaagtgctgggattataggcatgagccaccgcgcccggccacattcccctttttctggcaactctctggcatctgccctaccacaccttccttccatgtgttttaggaagtgttgacctatcccagatccagagatggacgtgtgacttaggcctggccaatcagaacatccaacagcattccagaaccactcatagcatgtggttcagggatgggcatgtgacccaactcaatctaatgagattcaatcctgaacctttattgggatgattagaaatgaaaagctttctgtatgttgatattattagaaggataatggaagtattgaggctcccaagccacccgctggagagaaaactcacttgtgagtaaaatcagtgccagggaaagcagagcggtgaagcaggaagaggaaaactgagttccggtgacatctttgagcccctggattcagccatgcctgaatcccactagacttttcagttacatattgtagtaggtacccttctttgctcaagccattgtgacttgggttgtagtcacttgtaaccaagagaccattttgaagggctgctattgcgaggattaaatgagatggtgaattacatgaagtgtttagtacaatacgtgctccaaaagaaaaagtcattattattttgcagtttcatcttccatacacatatttaaatctgttttcccttttacgttctttacctaagaaaaaaatgtttaaacttatctataatcaaagctggtattcacttgggaccagtgtagttatactggttatttaaatactgaaatacattcataatagttgataaacagtactgttctgaatctcccacatgctctgtggctctccagaatgcacccaactcgtctgttggaatcctctagctcattctactatctagcacctaaaaggttaacaccaggtctagcagggcctcctgtattctgtttatgattagcgtctcattcatgctacatatttttaatatcacctctgggtacatctgtcaactcgtcaatatgcctgcattaaatggaaacactaaattatcaacagctccatgaaataagacccttactcccctccaaatcaccaattattgataactatgtaacctcttctgatcctaaaaatgccagagacataattatgcacagtggtgacaaagcaggcatgggcaccaggccaagtcctatctttccccttcctgttactttacagagcctctacccttatttctacatcatggtcatatttgtcattcctagttgcaatctgatattcctttgttttaatacactatggctggcctaactcttcctccatggtgggacatatggtccatttttgttcagcttttcaaatgttaaaaactcactctgctggaaattgaatttccatgtggtgcccatctttctggtaataagccatggatttccttcctgattcaaacttcagttttgtgaatcacaagacacagtttaactttttgtctgcaaatgttttctgttgctgttctttgaaataagaacccatgtgctcaattgtgtaatgctgtagtttaataaattattcattttgactctaagtccacaaaggactcaaagtggtttatacaaatatatacaccttgaaatcaatacatgaggtggtcaaggagaaggaaaaataaggagtagtatatccgattggtattgtgttcagctgctggtaagagagaccaggaataacagtggcataaacaccacagatgtttatttttctcttacacaaatgaaatctagagagaggaaacccagagctgatgtggtagctccacaaaattgaggatacgatctctttctatcatcctgcctcactatccttagaatgtggcctccatcctaaagtccacctcgtgctgcaggatgactgcaggagctccagctattgcagccacatttcgggcagcaagaagaaggaaatgaaaaaatcctgtaatcccagttttctttaaggatcattttggaagttccagcccaaaacttcagcttacatataattggccagaatgtagtcctagctacaaaggaggctgagaaatgtaatctcttagttgtgcctgatgccaccccaaataaagttcagggcttatttactaggaaagaagggcaaatggataatacataggccactagtcatttctgccacaggtaagaaaatgaaataaagcgagacatttagctggttcacaaaactgcctactataaggacctttaaggtgtccagctgccaaattgtctctgagaatcctagtaatgatagcagaaggggaatctatgactaaatactaagtgtaatatctaagcaaagagagcaaaccattgctaaaaaaaaaaaaaaaaaaaaaaaaaaaagcttcttttctcaatacagagattaaaaagcaactctacccacaggtctttgtgaggaagacatgggacatgtggacgatatcctcacaatatttctgcaataatgaaacaacatgattctgggacttgcttcaaatattcagcgtgggggagtgggtaggagtatagcgaaaaccagatgggccatgagttgataattgttggactgggtgatggagactgctttgttatatgtttccctttactgtggtgtacatttaacatttttccataataaaaaaagaatttaaacccagcaataaatcctttccaacaattgctttttaaaatgctccttttaataaacttgcttttaagttcaattgacaggtggtttttatcataactcctccctcatatttttggcctttgtatctactgtccttatttattaacttatttttaacagttttattgagatagaatttacatacaattcattttttttttttttttgagacagggtctcactctgtcacccaggctggagtgcaatggtacgatctcagctcactacaacctctgccttccgggttcaagggattctcctgcctcagcctcctgagtagctgggtctacaggcacctgccacgacgcccagctaatttttgtacttttagtagagacggggtttcaccctattggccgggctggtctcaaacgcctgactttatgatctgcccaccttgccctcccaaagtgctgggattacaggcgtaagccacagcacctggcctacaattcatctttaagtgtgcaattcaatggtttcttgtagttgtgcaaccatcactacaatctaatttcggaatgttttcatcactctcaaaagaaaccccatccccatctctacccatgctcctttccccacccccacccccagccctagacaactactaatctactttctgtctctatgcactcccctattctgtatatatcatacagatcatcatacaatatgttttttatgacgagcttcttccacttaacatgatgtcttcaagcttcatccatgctacagcatgtatcagttctttataactttttacagctaaagaatattccattattttgatatacattttgtttagacaaccatcaattgatggacatttgcattgcttccaggtttggggtattatgaattatgttgttaagaatcttcatgttgctgggcgcggtggctcacgcctgtaatcccagcactttgggaggcggaggcaggcggatcacgaggtcaggagatcaagaccatcctggctaacacggtgaaaccccgtctctactaaaaatacaaaaaattagccgggtgtggtggcgggcgcctgtagtcccagctactcgggaggttgaggcaggagaatggcgtgaacccaggaggtggagcttgcaatgagccgagatcgcgccactgcactcaagcctgggcaacacagtgagactccgtctcaaaaaaaaaaaaaaaaaaaaaaaaagagagaatcttcatgtttctatgaagtttctatgtgtatgtatatttttgtgtctctggggtatatatacctaggagtagaattgctgggttaaatggcaattctatgcttaatattttgaggaactgccaaactgttttccaaagtggctgtggtatcttacatttttgccagcaatatataaggactgcaacttctccacagcctcactgacacttgttattatctgtcttttattttatcctcactagtgggtgtggactggtatttcattgtggctttaatttgcattttcccagtgataataaatttaatcatcttttcataagcttattggtcatttgtatatcttctttaaaggagtgtctattcaaattctttgtccatccttcagttgggttgtcctttttttttttttttttttagatgaagtcttgctctgtcacccaggctgaagcgcagtgatgcaatcttggcccactgcgacctctcagcctcccgggttcaagcgactctcttgcctcagcctccaggcagctggaattacaggcacatgccaccacgcccagctactttttgtatttttttagtagagacggggtttcaccatgttggccagactggtcttaaactcctgacctcaggtatctgtccaccttggcctcccaaagtgctgggattacaggcatgagacaccgtgcctggcccattgtcttttcatgatcaaaaccacaaatagaaagggcattgtaaaaaatcccacagctaacatcatacttgatggtgaatgaatgctttccccctaaaattagcaacaagacaagatgtctgctctcattgcatctattaattattgtactggacattctagccagggcaattacataagggggaaaaggcatccagtttagaaaggaagacataaaattttattctactttcagatgtcttgatcctgtatattataaatggcatggaatccactaaaaattgttagaattaataaacaagcttagcaaagctgtgggatataagatcaacatacaaaaatttatctctatgaagtgtcaatgaaaaatcagaaaataaaattaagcaaacaattcattttacaatagcatcaaaaaggataaaatacttaggaataaatttacagaagtacaaaacttatgctgtgaagacttgaaaacactgttgaaatattaaagaagaccgaaataaaaggaaagtcattgcattttcatggactgatagacttaatattatcaatgtagcaatactccccaaactaatctacaggtttaaagcaattcctataaaactcccagctggggccgggcgcagtggctcaggcctgtaatcccagcactttggggggctgaggtgggcagatcacgaggtcagcagatccagaccatcctggctaacacggtgaaaccccgtctctactaaaaatacaaaaaactagccaggcgtggtggtggacgcctgtagtctcagctactcgggaggctgaggcaggagaacggccgtgaactcaggaggcggagcttgcagtgagccgagatcaccactgcactccagcctggacgacagagcaaaactccgtctaaaaaaaaaaaaaaaaaaaatcccagctggtttctttttagttggctgaccctaaaattcatgtggaaatataagcaacccagaacagccaagacaactttgacaaataacaaaattggaaaactcacaattcctgattttaaaacttactataaggtcacaataatcaagacagtgtggcgttggcataaggatagacagataagtcaatggaacagattaagaggacagaaataaacccttacatttatagtcagttgacttattacaatggaaccaaaatagtttgatgtgacaatataatcttttcaataagtggtcacgtgaaaacaatgagtttggactccttcatcacatcatatgcaaacaataactaaaagtggatcacagacctaaggataagaactaaaactataaacttcttagaagaaaacattggaataaatatttgtgactttgggtaaagcaaggccttgttacatatgatgtcaaaaaatataaatgactaaagaaaaacaatagatacattggacttcatcagaattaaacacttgtgtttcaaaggacactatcaagaaagttaaaagacaagcaactgaatgggaggaaatatttgcaaatcatatgtgataaagggcttatatccagaatatctaaagaatacaacccaatagtaaaaagacaaataaaccggcagggcacggtggctcatgcctgtaatcctagcactttgggaggcagaggtggatggatcatttgagatcaggggttcaagaccactacacctggcctaaatcctgggttttaaatctggataatgtccatgcatgaaagagcctgaccacctgtgttggacccccaggtccattatacctagctgtgtgacctcaggcaaattactcaacctctctctgcttttgttatctcatctataaaatggggataaatatagtagtaccacttttagggatgtttgaggagtaaatgagttaacgcatataaagaagagcataataaggagtctaatactagccactatcatcatcatcactataggtcatttggatataacagatacagccctggtacaaacattgtcctgtttcactgtcgtaggtccagcacctaaaagagtgtgtgtggcatattgcaggcgcttaataaatatctcttgaataagtacatgacagcgaatacatgaatgaatggatgaagaaaatatgggtatagtagagctttggtttaaaagtggaagatgacaacaccaaatgctggcaaggatgtggagcaacagaaactctcattcattgctagtagtaatgcaaaatggcacagccacttctgaagacaggttggcagtttcttacaaaactaaacctactcttaccatatgatccagcaatcacactgtttggtatttacccaaaggaattgaaaacgtatttccacacaaaaacctgtacatcatgtttatagcagctttattcatagttgccaaaatcttggaagcaaccaagatgtcctccaataggcaaatggatgaataaactgtgacaccttcagaccagaaactttaaaaacaggggtcgggggtgggggcactatcaagccgtggaaagacatggaggaaacttaaatgcatattactaagcaaaagaagtctttcagtctgaaaggctacatcctgtctgatttcaacgacatgacattctggaaaaggcaaaactatggggactgtaaaaagattagtagttgccaggggttagagaaaagggagagatgaatagttggagcacagaggatttttaaggcagtgaaattgttctgtgtgataccataatggtggatacatgccattatatgtttgtcaaaacccatagaatgtgcaatcccgaaacctaatgtaaactatggactccgggggataatgatgggtgataataatgtgtcaatgtaggttcatcagttgtagcaaatatattattgtggtgcaggatgtcagtagtaggggaggttgtgaatatgtagggatgggggtatgttgaaaatttctacagaaattctattttccactcaattctgctgtgaacttaaaactgctcttaaaagtaaagtttattcattagtgtaagaaattctggaagcctccgtggtaaggccagtcacacgcaggtgctctgatgtaccctagcactggtcatccagagattgggcttctcacttccttctcctggcagtgggccacttgcacagccaaagctaagaacagaagcctggcacacccccaggcgctggccaggccacccttagtgagccaaatacccccaccatggaaccactgctcagctgggtctggccacccagaagcacttacaaactctctgcatctatgtgtgaccagaagcctgatctccccaggcctcatggtggtgtttttaaagaaagcccccagaagctaggcccagacaaaatcagttcccaaagggacaaaggcgctcagtctcacaagttaagtaaaagacaaaaacagaagcaaacatttatatagcattaagcttgtgtctgcactcttcttagcttttacaaacataaattcatttaactttctccacaatcccacaaggtagggactagtattatcaccatgttacggatgaagaaactgaggcacagaaaggctaagtcagtagccataaaaccagtcaatctgttaacatgtcagagctgggtggtgaatccaagcaggctggctccaagaccctgttgatctctctgttgttctcccttccatgtacacagtactttacagtttgcaaaatccctttagcaatatagtatctcatttaagcctcacaaccatcggaggtaggtagggcaggtaatactatctttaagaggaatggcaatgagggaacagcaaatgaggaagctgaagcctagagaaggtaggtgatttgcccaaagttgcatgataaacagcaaaggctctggaggcaggtggcataggttcaaaccccagctattactgatcagcctcataatcttgaacaagttaatacatacctccgtgcctcagtttccccatctttcttagagtttttatgaggattaagcaagtcaatacatggaaagcactttatttaaaatgttggtggccaggagcagtgggtcacacctgtaatcccagcactttgggaggccaaggcatgcggatcactttgagctcaggagtcagagactggtcaacatggaaaacatggcaaaacctggccaacatggttgactcagcctggccaacatgacaaaaccctgtctctacaaaatatacaaaaattagccaggcatagtggctcacacctgtggtcccagctacttgggagactgaggctgaaagacagcttgagcccgggaagcagaggttgcagtgagccaagatcacaccactgcactccagcctgggcgacagagtgagaccccaactcaaaataataaataaacaaataaataaataaaaataaaatgttgtttgccgggtgcggtgattcacgcctgtaatcccagcactttgggaggccgaggtgggcggatcacgatgtcaagagatggagaccatcctggctaacacagcgaaaccccgtctctactaaaaatactaaaacaaaattagccgggcgtggtggcgggctcctgtagttccagttcctggggaggctgaggcgggagaatggcgtaaacccgggaggcggagcttgcagtgagccgagatcacgccgccgcactccagcctgggcgacagagtgagattccgtctcaaaaaaataaattaaataaataaataaataaataataaaatgctggtattttgggccaagcactgtgggtcacacctgttgtattaggttttcacactgctgctaaagacacccgaaactgggaacaaaaagaggtttaattggacttacagttccacatgtctggggaatttctcagaatcattgtgcagggcgaaaagcacttcttacatggtggccgcaagaaagaatgagggaagaagcaaaagcagaaacccctgataaacccatcagatctcgtgagacttattcactatcacgagaatagcacgggaaagactggcccccatgattcaattacctccctctgggtctctcccacaacacgtgggaattctgggagatacaattcaagttgagatttgggttgggacacagtcaaaccatatcacactgtaatccgaacactttgggaggctaaggcaggtggataacttgagtccaggagtttgagaccagcctggacaacatagtgaaaccccatcgctactaaaaaaatacaaaaattagctggccgtggtggtgcactcagctactcgggaggctgaggtaggagaattgcttgaacctgggaggtggaggttgcagtgagccaagatcgcagcactgcactccagcctggcgacagagcgagactccaactcaaaaaaaaaaaaaaaaaaaaaaattagccaagcatggtggcacatgcttgtaatctcaactacttgggaggttgaggtgggaggatctcttgagcccaggaggcagaggttgaagtgggccgagattgcaccaccacactccagcctgggcagcagagcaatatcctgtctaaaaaaaaaaaaaaaaaaaaaaagccattttgtttgtcatggatttttgtattcatttcgattttggtaaatattgcattacaaatactttatcttaattaccaagtttgttaacgctcccttaaattttgtctggcttgcttcaccctagtcctggccctgctttgcatgggggaatcctttaatacacactagctagtgtcatcccactacttgttgaatgctaactatatgccaagaattgctgttagaagttttataagtatacatcacctcaacaacaagaagaagaaaaatcagaaaccaagttgaaaagcaagtgacaggacaggagaaaatatctgtagtttatacaggcaaaagattggtgctcaaaatatataaagaactactacagattcatttttaaaaagacaaactacccaatacaacagcaggcaaaggacagaaatgggcagttcaccaaagaggaaaaacagatggtcagtaaacatatgaaaaaaactttagcctcactggttatgaaatacacatttggaagtgtgatgttatcaagggttgggaagagtgtaaggaaatgggattataaactgattataaactgatatagcctttttggagggaaattcaggatctctattaaagtgaaattgcatacacccactgactgagctatttcacttttgtctgcgccagagaaacacgtacacatgtgcatgaggatatttatcaaaactttgctctgaatggcagtaagttggaaacaccctaaatgcccctcaaaaagggaactgatcaataaaccacagtatagtcattctatgaagtagaagctacagggtttatttttaaggtagatcatgctattaattttggggtgcaaaagcaagtggtagagccatatgcactgtatgttgccacttgtgcttgcaaaaacaaccaggaaaaaaacagtactgaagaagttctcattggccgactatccaacagtcattgccttcttctttgctaataatctccaactttgtctgggtggcaccgtgccccatgccagggaaggaaccaccttttgtctcagccaaccttagcagtccttctcctatctgggagcccagtccaggccaggagcagcatctcccatcattagcccgggtctacagaggccagctcccacccctgaaattgtcacccacacatgtcttaagggtttggaaaatagagcatcttctgggctctttggcagaatggacttgccgggtgggttttttcacttcattcctgcaggcctgcctctctaggtctttgcttccttcctccatgggcttcaggggcagatctgacgtttctaccacacttggtctgcaccagcgtttttccaagctgccctcctgggagcatgtgagcatcatctcctggggaaatgccagggtgtttgagcctgtatcccaggacagtgctcctgaatgataaactctcccttatccaataccatatttcctccctgcactcctacccctccatccgaaaccttctggatccatttcctccacaatctcaagctcccatcagcacttatgacacaaattctggagcccctttggtgccaaatccctcagcatcccagaatatctaccagttgggctgtgcgggaaattgactcttgttattggtctggtggccagcaagggagaaatagatcattcttgttggttggttctccatctcctggaagtgttcaagagagattggaagggtccttggcaggtgatgttgactccagcctctgcaatcacatagccctaggttctagtcccagctcaagcatttcctagctgtgtgcctgtgggaattcacttaacctttgtaagcctctgtctccacctctgtaaagggcaggaaataacagcatgagccttgcagtgttgttgcaaggattaattgagatggcatcttcaaagctccctgcagagggcctgcctggctggctaagccacttggataggcccttcccaacaaacttgagattctataaataagaagaaatgtggctgggcacagtggctcatgcttgtaatcccagcactttgggaggctgaggtgggcggatcacttgaggtcaggagttcgagaccagcctggccaacatgaagaaaccctgtctctactaaaaatacaaaaattagccaggcgtggtagcatgtggctgtaatcccagctattcagaaggctgaggcaggagaatcgcttgaacccgggaggtggaggtttcagtgagccgagatcatgccactgcactccagcctgggtgacagtgaaactgtgtctcaaaaaaagaagaataagaagaaggagaaggagaagaaggagaaggaagaagaaggaagaataaagaagaagaacaggaagaggaaggagaaggagaagaagaagacaaagaggaagaggaagaggaaggagaaggaggagaaggagaagaggaagaagaggaagaaaaagaggaaaaagaagaggaagaggaagaagaagaaaagaagaagaagaacaagaacaagaagaaggggaagaagaagaagaagaagaagaggaagaggaagaagaagaggaagaggaaggagaaggaggagaaggagaagaagaggaagaagaggaagaagaagaggaaaaagaagaggaaaaagaagaggaagaggaagaagaagaaaagaagaagaagaacaagaacaagaacaagaagaaggggaagaagaagaagaagaggaagaggaagaggaagaagaagaagaagaagaggaagaagaagaagaggaagaggaagaagaagaggaagaatgcttcctagaaccagttgggaattgaaagcagtatctggagttgggtgagaagaagaagggacttgaaggggcaaaggaaactcaagctttgttcagctgcagttgtcaagtgtgctgggctctccccagggaagacacccacctgctggggatgacacaccttgccgggaaaacaaggtgctggtgtgtgcagtggtacagggcactgaaaagaacgtggcctaggacacggacagacctggctggcttgagccccttatgagcctcaggcttggagcaagtctctgaagcacaacttctcagccattgctctatggacagtgacagccagatcactctttgcagtgggggctgtcctgggtattgtaggatgtttagcagtatgcaccgtctctacccactaggtgccaggagcagctcctccccccaagttgtgacaactaaaaaaatgtctccattgacattgtcgacattgccaagtgtccccaggggcacaaaatcatccccagttgagaactacagctttaaatctaattaagccttcctggtcaaattgggataacagtgatagtaatactgccttgtatggtggctgtgaggatttccttccttccctccttccttccttccttccttccttccttccttccttccttccttttctctttctttctttacttttagagacagggtctcactttgttacccaggctggagtgcagtagtgcaatcatggctcactgcaccctcgacctcctgggttcaaacgatcctcctgcttcaccctcctaaatagctgagactacaagcatgtgccaccatgcccagctaattttaaaaaatttttttgtggagatgagggtctcgctatgttgcccagcgtggtctcgaactcctagcctcaatccatcctcctgcctcagcctcccaaagccccgggattacaggtgtgagcccctgtacctagccagggcatttcttgagcatttactagatgccagtggctgtgctcatgctttcatgcatcagctcccctcctcccatagcccatcccacatggtgcttttaccctcatcctccctacatagatgaagaaactgtaaacatctttcttttcatcacattcacattcaaccaatacctcccaaggaagggcctcttatgtgccaggattctgggagggattgtggcacatatgtaatctcactggtttctgggtgggtttggctagttgagaaccactcacagtagaccgaagggtgaaaggaggggagaatccaggatattttctctcgttctctctctctgtgcctccaaagcatcatcagcagctgctgtgcctcatctgtggctgcagatccagctgtacagtctgtcccttggtgatcctggatctagctgggcaggccatcaggattctgtctcctgccaggtggcccagcttcaacttcacagcatggtagcaccaactgttctctgctcctcccccaacaaagatggcatcatcttcctgctatggtttagcactgagttgtctaacatgccatttggcttctcacttctatcatctgtgtgaccaattccttgtattatattccctctatttgaatacctagtgggatttctgcttctctgattggtctctgacggctccatatgagatttggtttcctagttcatgctcttggacaccacaataatcagctctttgctgtacatggagtatatctcctgaatataaagataaatgtgtttgatagatgtattagtcaggactcttttgattgcaagtgacagaaaaccagccttaattggtttaagcagaagaagggaatttattggcttatgtaactgaaaagtccaggggatgtttggcttcaggtacagtttgatccagcaactgcaatgctgttgtcagtatgtctccatctctagctcttctttcctctgtgttgacctcatgcttaggcaagctcttccactaaggtgacagacaatggtttcagcatcaacaaacctacacccttcaagtttaccaacttcagtagaaagtcctctttctcaatatttccagctgaagtcccaggcaggattctcattggtccagcttggaacacatgcctgtttctgagccaattactgtgacaaggcaagatactgggttatacatcgaacccctgcagctggacagtggggtcagcatcccccaaaccacaaagtccaagaatgggagtgaggtggttcctgagaatagtgaaggggtgttgttaccaaacatcaatgcatgtgcactgatagatacatgttatttggtttactcgatggtgatgccgagctaaccagcagatcaggaggagcagaagattagcaatcagaagacccatgtttgagctcagggtcttcaggcacccttctctgaactgcaattttctcatgcataaaattcaacaaaaaacaataaccggccgggcgcagtggctcacgcctataatcccagcactttgggaggccgagatgggcagatcacgaggtcaggagatcgagaccatcctggctaacatggtgaaaccctgtctctactaaaaatacaaaaaattagccaggcacggtggcgggcgcctgtagtcccagctactcgggaggctgaggccagagaatggcgtgaacccgggaggcggagcttgcagtgagccaaactcacaccactgcactccagcctgggtgacagagcaagactccgtctcaacaacaacaacaaaaataataataataataataatcacaaacattaagtgaatggcaattatataccaggcacttatgtaggctccagaaatacagacgtgaaggaaagaaaaatagagtcaatatcccctgaagtgcacatgtagctgtaagaactacttgagattctttgtgcaaaatgcctcgctgagcccctatcagggcctcagaaggtagtggttgagttgaagtttgaagaaaagagagaaaggcccttataaagtatagactactatggcaaaggctgagaggagtacaccgtggcttttctccgtttctaccttagttaggctcatggttgcctggaattaagactacacgtgactggcctggtgcagcgactcacgcctgtaatcccagcactttgggaggttgaggcgggcggatcacgaggtcaggagatagaggccatactggctaacaaggtgaaaccccgtctctactaaaaataccaaaaaaattaggcgggtgtggtggcaggcgcctgtagtcccagatactcgggaggctgaggcaggagaatggcgtggagccgggagacggagcttgtagtgagccaagatcacaccattgcactccagccctggcgacagagctagactgtctcaaaaaaaaaaaaaaaaaaaaaaaaaaagactacacatgactaagttgtagtcaaggggatgtgtgtgaaaatgtagtatggaggggagctgggagtggagggggcagggagtgttctttttctgtgtgagacggagtcttgctctgttgcccaggctggagtgcggtggtgcaatcatagttcactgcagcctccaattcctggactcaagtgattttcctgcctcagcttcctgagcagttgagactacaggcacacaccaccacaactggctaatttctttaatttttttttttgtacagacagggtctcaccatgttgcccaggctggtttcaagcacttggcctcaagtaatcctcccattttggcctcccaaagcgctgagattaaaggtgtgagccaccacgcccagccaagggggtgttcttaaaggaagaaacgaggcacctaggtgctccttcggcttccctggtacctgaaatgtgcataagatgacagctggcagagcaggcagcttggaccatgaggggttaactactggatcttgcccctcatttctctcatcttttttttcttttttcttttttgagacagagtcttgctctgttgcccaggctggagtgcagtggcacaatcttgactcactgcaacctctgattcctgggttcaagtgattctcctgccccagcctccccagtagctgggattacgtgtatgtaccaccatgcctggctaatttttatatttttagtagagatggggtttcgccatgttgcccaggctggtctcgaactcctggcctcaagtgatccacccatcttggtcccccaaagtgctgggattacagaccttagccaccgcgcccagcctttctctcatctttatgtgaaaaaatgtctcttgacctcatctccagctataactccatctctttccttctctttgcagcaaaactcaaagagtctatatctcaaatttctctcttcttactcacccccgccctgcatgtggctctatcccagggtcacttcaaagtcctcatccatcctggacccctcagcagcatgtgacacagttgctctctctctcctttttcaaaaagtttggtaaaatatacataacataaaattgaccattttaaccagtggtattaagggtacagttccaatgagaagagttggacacagggcggggaacatcacacaccggggcctgttgtggggtggggggatgggggagggatagcattaggagaaatacttaatgtaaatgacgagttaatgggtgcagcaaaccaacatggcacatgtatacatatgtaacaaacctgcatgttgtgcacatgtaccctataacttaaggtatataaaaaattatctgataaataactttaaaaaagggtacagttctgaagcattaagtacatttgcactgttttacaactgtcaccaacatccacctccaaaacttttttgtctcctcaaattgaaaatttgcatccaagccaagcacagtggctcacacctgtaatcccagctactcgggaggccaatgcaggaggatcacttgagtccaggagtttgagattagcttgggcaacatagcaagactccatttctacaaagaattgaaaaattagccagacattgtagtgtgcacccgtagtcccagctactcaggaggctagagcaggaggatgacttgagcccaggagttcgaggctgcagtgagctatgctcatgccaccacactccagcttgggagacagagtgaagcactgtctccaaaagaaaaaaaaaaaaaaaggaggccaagcatggtggctcacacctgtaatcccagcattttgggaggcctaggtggcagatcacctgaggtcaggagttcaagaccagcctggccaacatggtgaaaccctgtctctactaaaaagacaataattagccaggtgtggtggcgggcacctgtaatcccagctactcaggaggctgaggcaagagaatcgcttgaatctgggaggtggaggttgcagtgagccaagatcatgccactgcactccagcctggtgacagagtgagactccgtgaagaaagaaagaaagaaagaaagaaggaaagaaagaaagaaagaaagaaagaaagaaagaaagaaagaaagaaagaaagaaagaaagaaagaaagaaaggaaagaaagaaaggaaagaaagaaagaaagaaagaaagaaagaaagaaagaaagaaagaaaggaaagaaagaaagaaagaaaaaaaaaaaaaagaaagaaattctgcattcactcccaattctttccaccccaccccctccagaccctggtaacctctaatctattttctgtctcaatgaatgtgcagattctagatatttcaaaaagtagaatcatgtaatatttgtcctttgagtctagcttctttcatgcaccattatgtttttgagactcacccaggttgtagcatgtgtcatacttcattcctttatgtctgaatcatattccattgtagggatagaccacatttgtttatgcatttatccactgatggacatgtgagctctctccactttttggtcactgtgaataatgctactatgaacattcacagaggacctttgcacggacacagattttctcacctaggagtgaaattagtgaatcccatggtaaatttaacttcttccctcctgaaacaattttctttcttagcttccaggacacatttggcttcctcctgctgtgtccgctacttcttagcttcctttcctggctctctctcttcctctccacctgccagatgtgacgtgccccaggggatcccagacaggccctgttctctattctacccacacctactccctagggatcccatttgggctctgactttgaaaatctctgtatatgcggatgactccaaatttgtatctctgcctcttcactgaacttcaggctccccttgtacatccaactgccacctgacatccccaccggtccagagtggagactgggatcatgcccacaaatctgttcctcccacaggctccccatctcagtaaacggcaccttcatttttcccattgtgctggccaaaaccttggaatcatcctggattcctctttttttcccacactctacctccaatccatcagcaaatcctgctggctctgccttcaaaatgtacccaggatccgaggatcgcttgagcccaggagttcgaggctgcagtgaaccatgactgtgccactacactccagcctgagcaacagagtgagactctggctcttaacaacaacaaacacacacacgtgtacacacacacacacacacacacaaaacagccaggcatggcgactcatgcctataatctcagcactttggaaggccgaggccggagaatcccccgaggccaggagctggaaaccagcctgggcaacatagtagacctcatcactacaaaaaaatttttttaattagccaggctgggcagggtggctcacacctgtaatcctagcattttgggaggccaaggcgggcggatcacttgaagttgggagttcaagacaagcctggccaacatggtgaaaccccatctctactaaaaatacaaaaattagccaggcgtggtggcgggaacctgtaatcccagctacttgggaggctgaggcaggagaatcacttgaactggggaggcagaggttgcagcgagccaagattgtgccattgcactccagcctggatgacaagggtgagactctgtctcaaaaaaaaaaaaaaattaggcatggtagtgcatgcctgtagtcccagctacttgggaagctgagatgggaggatcacttgaacccaggagttcgaggttgcagtgaactatgatcacactatagtacaccagcctgggcaacagagatcctgtagcttaaaaacaaaaatgtacccaagagccaatcacccttcacctcatccacctctgccctaccgcagggccaggtcatcacatgtctcacctggactctagcaatcaccttctccctggtgtctgtgtcccatccctgccccgacagtctattctcccacattgcctgaaggatcctgttagcacccaacgtcaggtcagggctttctttactcagagccttccacggctcccagctcacccagagagcagccatagtccccacaatggcccacggggtcctataggacatgtctcctccccattgcctctctgccttcacctcctcccactctcaccctggttccctctattccagccataccagcctcatggctatttcttcaaaactccagtcacactctcactgcatggctcttagactttctgttccttctgctgaaatgctcttcccacaccaacttcctttacctccttccatttttttctcagtgagactttccttgcaaacctacttaacattatccccccaacacttcctacctctttctttttctttctttttttttggaaacaaagtcttgctctgtttcccaggttggagtgcagtggagcaatctgggctccctgcaacctctacctcccgagttcaggcaattttcgtgcctcacccgcctgagtaactgggactacaggcacacaccaccatgcttagctaatttttgtatttttagtagagagactgggttttgccatgttggccaggctggtctcaaactactggcctcatgtgatctgcctgcctcaacctcccaaagtgctgggattacaggtgtgagccaccgtgccctgcccttaccccattctctgctttatttttctctagagcactcatctccatctaccatgctgtacatgttacatattgtcctgttcactgtctgtctgcctgcactggaatgcaaggaagagatgaggacttgctccctggagtagccccagcacctaaaacagtaactgacacatatctgttaactgaattaacacaaactaagccaaaaaaaaaaggacttgttggctaatagacctgaaaaaatctgggactgggatagcttcaggcatggctaaatccaggagctcaataccatcagaactcattctttccatgccttggctgtgttttcctctgggttaacctcactcacaggctaactccccaagcatggcaattgcagctctttccccttttcccattattcctgcaggatttcaagtctcaagggaacaatttgggtcatgtgtctattcccaatcactgtggccagaggatggacagctctaaagggctgaaagcccaggaggcagccaggggagtgtgaaccttccagaagcttttctgatggccccactcagcaactctgcctccagctcattagcccaaactcgctggtcattcccagcttcaagcacctttgggaaagtggaggctttatcttgccagcctccaaaaagagcaaaaggcaaggggaaaggggttgtgaagagcttttgggtgaagagtacagtactttcacaggctcctccaacctcgaagaacagggagaaaggaattgaggacaaaagtcaacacgcctcaggcaaaccatcttatgcaattttgcccaaggctgcagtttcagttcaatgaaatcctacaaccactcactgggcaataatgccatgcaaggtttttctatcttggcactactgacattttggacagaatgtaatgattctgggccgggtgcggtggatcacgcctgtaatcccagcactttgggaggccgaggcgggcggatcacgaggtcaggagttcgagaccagcctgaccaacatggtgaatcccccgtctctactaaaaatacaaaaattagccgggcgtggtggtgtccgcctgtaatcccagctactcaggaggctgaggcaggagaatcgtgtgaacctgggaagcagaggttgcagtgagctgagattgcaccactgcactccactccagcctgggcgtcagagctagactccatctcaaaaaaaaaaaaaaaaaaagaatgtaatgcttctctgttgtgggggctagctatcctgttgattgtaggatatttcacagcatccctgacctctaaccctagaccccatccccagtcatgacaaccaaaatcatctcctagacattgtccaatgtcctctgctgggcaaaatagcccccagttgagatgcactgcatttctacagtctaagttccataagagcaggttgcctgtttgctttacagctgtgtcttccgcacgtagcacaatttcttggcacatagtaggtgttcaattaatagttcttgagttgcatgaatgaacaaatgaatgaatgcctgatgcagtgcagtactggggtccacacagtgaagaacacacagaccttacccccaagaagatcaagatctagtagaagccccaaagtgtttccaaaatggggaaccttctgtccctctcagtgacatgtcacaggaactcacaagctagcaggtcagaggctatgccaccaaaccacagtgggcttcatgcgctctgcagacataacagccacggtcaggcttacagtcaacaagggaaccagaacagtgaggccagctgggtggtaggcccgctagaaaaaatttaatccctttgaacccatgagcaacaatgtgatgtgtcgttttctttttcttttttctttctttctttctctctcttttttttttttttttgtgtgtgtgatagggcctcactctgtcactcaggctggagtgcagtggcataatcatagctcttcgcagcctcaacttcctgagctcaagcgatccttccacctcagcctcccgagtagctggggcaataagcatgcaccaccgtgcccggttatttatttgtttatttatttatttattgtagaggcaagatctcactatgtttcccagacttgtctcaaactcgtggcctcaagagatcctccagccttcgcacccccgaagtcctgggattacaggcatgagccaccaccccagcctgttttatttttctattgagatataatacacatatgtcaaaattacccttttaaagtgtacaattcaatggtttctagtatattcacagagttgtgtaaccatcaccacaatcaatttttgaacattttcatcaccccaaaggacacttataccgatgagcaaccactcccatttaacccctcctcccatcctctggcagctgccacctgctttttgtttctatacatttgcctgctctgggcatttcatgtaatatgtggccttttgggtctggcttctttcatttagcatcacggtttcaagatctgtccatattgcagcatgtatcaaggcttcacgcctttttgtggctggataatatcccattgtatggatagaccacacttcatttatccttccatccatccatggacatttgggctgtttccactgtttggctattgtgaataacgctgctataaacatccattttttacgagattgtgtgtgtgtaccttgtaccattttcttgggtgtatatctgggagtggaactgctgtgtcttatggcaatttggtgtttcctgaggatggctctgctttgaggactgtgctgaaaatggtgggacaacagtttccagcctcttggacttctcaaaggcagtaaaaattcttaaaaataaaatgaatgattgggcaaccgaaataagatggtctactttttatattgccaagtaaagactacaggataaaataaaattaaagaaatattttttccattacttcacagtaaaagaacattttaaccaccaacatcactacccccaaaaaggaaaggagattaatatattaacataaatggtagttgtttaagtttactttcatgaaaatttcactacatgcctgtgtgttcccccatagtaccaggaactgataaacaaagaagcaaacgacctcctcaccatctacagtctagccaggtgatggtgggggggggggcggagagagaaagagagagagagagagagagagagagagagtgtgtgtgtgtgtgtgtgtgtgtgtgtgtgtgtgtggtcagaggatgtcggatgtcagatatcccaactctaaggaattctgagatgtgtaaaagggattgttttgcccaaaggaggttttcaggctctgaaaagaataaaatcccaggataactgctttaatggaggcacaagcaacaagagaaccccaagacagaaattagttctgattggctgggaacggtggctcacacctataatcccagcacgttgggaagccgaggcgggcggatcacatgaggtcaggagttcaagaccagcctggccaacataacgagaccccatgtctactaaaaatacaaaaatcagccaggcgtggtggagcacacctgtagtcccagctactcaggaggctgaggcaggagacttgcttgaacctgggaggcagaggttgcagtgagccgagatcacgccactgcactccagcctgggcgacagagtgagactcagtctcaaaaaaaaagaagaaagaaattagttctgatcatgggaaaaccaggtgagtagcaatgatctcagcaggctgagatgaattctatgcagccacaagtctgggagataatgtttaccagaccagagagaatctgtaattcctacggccttggtaccttcaggaatagagagattctattgccaaataatgacttccaggtggtgcattaatgacaacagtgggtagttttggtcccctctgccgctgggcccaggggactctgggaaccatcacccttggtgggatctggcttgggagttggccctaaatcgcctgccatgggagcgggtttagaggggaagcagtggccccccaggaggtcaggggtcctagagtcatctagaagaacaacagaaagaaatacctagggcaggtcaggcgcggtggctcacgccggtaatgctagcactttgggaggccaaggtgggcagaccagctgaggtcaggtgtttgacaccagcctggccgacatggcgaaaccccgtctctactaaaaataccaaaaaaaattagttgggcatggtggtgggcgcctgtaatcccagctactggggaggctaaggcaggagaattgcttgaacccgagaggtggaggctgcagtgagtcatgatcgtgcctctgcactccagcctgggcgacagagcaagaatctatctcaaaaaaaaaaaaaaaaagggccaggcacagtggttcatgcctgtaatcccagcacatggggaggccaaagtgggaggatcacgaggtcaggagctcaagaccatcctggctaacacggtgaaacctcatctccactaaaaatacaaaaaattagctgggtgtggtggcacgttcctttagtcccagctattcgggaggctgaggcaggagaatcacctgaacccgggaggcggaggttgcagtgagccgagaaggcgccactgccactgcactccagcctgggcgacagagcaagaaagaaagagagagagagagagagagaaagaaagaagagaaagaaagaaaagaaagaaagaaagagagagagaaagacctagggcagcagacaccaggctttggtctgtgaggctctgataccccgccccccacaagctgctgaatgtccttggagaatgagaggcgaggggatgggaggcaatggggctgaaatcacttctaggaaggaactaccctctgtgctttcccatcaggcaactgaaggagcaagttcccggggctggaagcacagcaatgagagggaagcacagaggtcacgggtgacagtggggaaaacgaggcagcagtggaaatgtatcagaagcaaaatgtgctgggttttgcctaaggctagcaatgcaaaacaaatcaggaaagtcccctggacttcgtgaggtgggctcaggcacacatggaaaattgtggtgagggaggagattttttcctaattagcactgagggatccaataagccaaacctttttcacacatgacatagctatcagattttatcccggtgccagggaagctcacgagaatgattctgagacaagatgatgaagccaaaatctttcccccggctttttttttttttttttttttttctaaagtgtaaaacaggaccaggtggtgagtctagttgaactgctcgagcattggtgctctctggtggccaatatagaaattgcattggcagcggtgcaaaagttttcctttttatgaaaaaagtcagataatctaagaggtgttgcagaagctagcattgcttaagagggatgtttattggaaggtgtaatcttggagttagaatctttaacatgcttcttctgaaaccagcttttcctcgttctctgtcttggtaaatggcctgaccacccattgttccccaagtaagaaacgtgggggtcacactagacacctactctccctcatcttcacactcaggcagtccctgaggcttgtgcccttaactgtctaaatttgcctttttcttcttcttttttttttttttttcctgagacggaatctcattctgtcacctgggttggagtacaatggtgtgatctcggctcactgcaacctccacctcccgggtcaagcgattctcctgcctcagcctctggagtagctgggattacaggcatatgccaccacgcccagctaatttttgtatttttagtagagacagagtttcaccatgttggccaggctggtctccaactcctggcctcaggcgatctgcccacctcagcctcccaaagtgctgggattataagcgtgagccaccatgcctggccttttttctttatttcttttttcttttcttttctttttttttttttaaagtttgggtctgctctgtcacccaagctggagtgcagtgggtgacagagctctctgagacctcaaattcctgggctcaagcaacagtcccacctccgtctccaaaaccactgggattacaggtgcaaaccactgggattacaggtgcgagtcactgggattacaggtgcgagccactgggattacaggtgcgagtcactgggattacaggtgcgagtcactgggccctgcctacctagcatcgcttctgtcatattctgttagcaacactctccaaagcccaaccagtttcaaggggaggggatgtagacctcacctttcaatgagaagagtgtcaacgaatttgtggactttatttcaaaacagccacaacaactaattcctgataaaaactgaaaatatgacataataaggctttaaccacccccacgtttgtttatgtgtttatgatctgtttcccacgctacaaattaagcttgatgagggtaaagacttgggcattttgcccactgcagtgtccctgaggccaaggacagggctgaagaattacacggtgattagatcagaggaaatatcaccgtctcccctcctcctgtctattttaggccaaagcatccttcaacatccagctcacagctcttctccgtggtcttctaaactccagtttttctttgcctattcacctgagggtcactttgtgctatactaagttgtcacgtcttaaattacagcatccagtattaccagttcagctgctggagcctgacaccctggacccaaatcccagctctcatgtgaaccagccatgtaaccttggacaagaaacctcagttttctcttctgttaaatgggggaaatattggggattttgtaaggattcaatgagccaatttaagtaaagcactcagaacagtccctggcctataggaagcaccagagaagtagtgttagccactattgcctcttgtatctctgcattgtagggttctttatccatcaattttttctttctttccttctttctttctttctttctttcttttctttctttttctttctctttctttccttcttccttctttctctccttccttcctctttctttctttttctttccttcttccttctttctctctccttccttacttcctttctttctctccttctttccttccttcctttctctctctctctctctttcttccttcctttcctttctttctttctttctccttttctcttcttctctctctctctccctctctctttctctttctttttttttttttgagtcagagtctcactctgtcacccaggctggagtgcagtggtgtgatcttggctcactgcaacctccgcctcacgggttcaagcgattctcctgcctcagcctcctgagtagctgggattacaggcatgtgccaccacacccatctaatttttgtatttttagtagagacggggttttgctatgttggccaggctggtctccaactcctgacctcaagtgatctgcccgccttggcatcccaaagtgctgggattacagacgtgagccaccatgctcagcctctttcttttttgagatggagctttggtgtgttacccaggatggtcttgaacttctgtgctcaagtgattctcccacctaagccccccgaccaagtagctggactgcaggcatgagccaccatgcctggctgtattttcttttcctaaaccgctttatcaagatacacttcacataccatagaattcacccatttaaagtgtacaattcagtggccttcagtatattcagagtcgtgcaaccatcaccaccatctaatttgggaacattttcatcatcctgaaaatgaaagccagtacccatgagcatttactcctcatttccccctcctcctaatgcctgacaaccacgaatctactctcagtgtctgtggatttgcctatatccatggtattttgtttcttgcatcctttcatctttgtcttgttttctgcctcccaataataataaaccataagaccctggacactctgtcctctcttttgtgtcccttcctggacttcagtgagtgattcacctaatgggcatctgctgatcaagtaatacactggccctttgactgagaacaagcacagagcatctacaatgcatcgggtaatattccaggtgctgcatatacattaactcatatgatccttacacagaaatccatgacacaggcactgttattatccccacctgactgatagggaaactgagacaggagaagttgagtaccttgccagagtgacatagccagcaaggaggcaaagccagaattcaaacctggacatttatgcctggagtctgcactccaccactgcaccacactttctcctgtgaggccaagtggatgggccttcatttgcgagcagttccaggaaacctgcacgggggctgggaaagagcaaggtggaagctgctgtagatgctccccccaccaaccaccaccagccaactacgtcccttagtatttcacagccttgtgtagctcctcaagtgtgtattctggactgctctagcaacttgatttaaccaatagaatgtagtagaagggacgctgtgccactccaagtcaaagcctaaagaaggcctggcagggcacagtggctcacatctttacagtacattgggagaccaagccagctggatcccttgagcccaggattttgaaaccagcctggggaacatagtgagaccccatctctatgaaatttttttttttaaattagccagagtggtggtgcactcctgtagtcccagctactcaggaggctgaagtgggaagactgcttgagcccaggaggtcaagggtgtagtgagccatgattgcaccactgcactccagcctgggtggtagagtgaaaccctgtctcaaaaaaaaaaaaaaaaatcctggtggcttctgttttgtcactttttagaactctgagtcacaatgtaagagatctggccaccctgctgaagaaaccacataggaagaggccctcagtctacacagggagcgctccaggtatcccagctatcccagcattttggctgtcccccctcaaagtcccagacatgtgagtgaaccattgcagacattctagcacagttgagctcccactgatgacctcagatttagttaagaccacatgcagcagaagagccgcccagctgatcctagtcaacccagagcatggtgagtaatcatcaactattgttttaagccactaaggagtagacagtcaaacagcagtagataatcaaaacaaggagtaagaccacttctgtggacagaagacccatgaagggtctgacctcatgattccacagtctcctgctgactcaaagaagagggtagaaagctaatcagaagagctgagtgtctgctccagccagcagctggggtgcagattcatgaccttcactcagctggtcagatgtgttggctcaggactttgaatctggagtaagcaacacaaaagaccaggaggtttagacttgttctgaaaggagtggtggtgacatctgactagcatcttgtttccagtggcagcccctgaggcaaggccaagagtggggatgcagcatccagccaagacagcaacagcatcctttccagaatcttctttggtgcaatttctgaacccttcacatccctcattttccacctattttctgagcctgattctccagtcttctgattcattttgaaaaagactctcatcattccaggaaagcacttttgcagctgaagttagcagtagtttgtgtattgattgggtttgtttgcatgcaacagaaaactcccaaacaactgtggcttaaacaagatagttgattttctctttgtgaaaaatgtacagaactcagcagtccaggtcccaccaggtcttcagagacccagtatccttgtgtcttggtgctctggctccgctccacgtggcacattgcctcagggtctaaaatagctgcccaagctccagccattgtgttcacattctggccaggagagaagaggaaaggttaaagaaaaacatgcccctccctttttaggaaaccacttggaagtccctcctaatcctttgcttatatctcatagctagaacttaatcacaagaccacgcttaggtacaaggaaggcaggaatgagcagtccttagctgagcggttaggtcctcaactaaaaataagagttatgttgctaaagaggaaagaaagaatgatgctgaaggaggctactggagatctctgcctgggtctgcctctgctgtgttcaaccaagaactctgcatgggagagccaagccagactgatgcaaggcaagtgagctccaaaactggggcttcacctgggagggttcttggctttacccagcagagaattcaagggcaagtcagtggtgttagacagcaacttttattgaagcagcagtgtacggcaacagcagaggtactgctccttgcagagcagggctaacccctgggcataggggttgttggcagctgtatttatatccacttataattatatgttaatgaagaggcacgttatccagaactttctggaaaaagggtgaggagtttctgaaaccatataaagtaacttcctggctgttgccatggcatttgtaaactgtcagggtgctggtgggagcgtctttgtgctaacgagcagtgagggcaactagaggtcactttctttgccatgttctgtttcttcactgcatcctgtttcaaccagatcctgctctgatgagctgggttgctatggtggttgtgatcagtgctcggaaaacaagtcctgctgatttacctcaagactgcgagatggtggccacgggagaggagggaccctgacaatgcctaatcacgttgacccagctggctcctctcttaattttctccaattcttttttatttttgagatggagtctcactctgtcacataggctggagttcagcttactgcaacctctgcttcccgggttcaagcgattctcctgtctcagcctcccaagtagctgggactataggcacccaccacaatgcctaattttttgtatttttggtagagacggggtttcaccatgttggccaggctggtctcgaactcctgacctcaggtgatctgcctgcctcagcctctcaaactcctgggattacaggtgtgagccactgtgcctggccttctccagtttttttaaacccttccacctcatttgtcttaaactcccaccagcacttccctgaccctggatcccctcattttcctgatccattttctatccaaggaaaacccacagtcccaacccacttcctggccagtctagctcccatgcctttatacatgctgttcctttcacctggaagggccctccttctccctgtggcttatctaaaggttacctgtgaggagcatttgtcatgcttcttggccacccagtatcttttgtttgtttttttgagactgagctggagtgcagtggtgcaatcactgctcactgcagcctcaacttcctgggctcaagcaatcctcccacttcagccttctgtgtagctggaaccacaggtgtgtaccaccgcgcccgactaattttttcattttttatagagacagggtcgaggctggtctcaaattcctgggctcaagccatccttctgcctcagcctcccagagtgctgagattacaagcctgagccaccgtgcctggcccccgcctcaatctttaaagccggtaatgtcattctgaaggctcccttgttaaataaaaaataaaaagccagtaacggcatcaccccaacctctgcttctgtcatcatatctccttctctgaccctgacctccctgcctccctctccctgacctccctgcctccctaagtacccctgtgattacatttggcccacccagataatccagaataatcttcccgtctcaagagtcttcatttaatcccatctgcaaagtttgccacgtgaggccacgtattcacagatcctaggggctcaagatactggaatctttggggtctaatatgaatctgtccactacagttaggttccccagaagcacatcctcagacaaggatttgggtgcaaatggtttatttgggggtgcttccaggaagcagcagtggaagagtggagaagtgaaactgggaagggaaggaagcctgagggggtcatccagccagacacctctgcgggcacctgaggctgagtccccagggcacctctaggaaactgagcagagaaccctacagcgctgtctgttcttccctgtggggctttccccaggctgttcaccatctggcacttctggtctgccccgtcttggctgaacacacatctgcagccagagacagcactcaggcctagagtctggcatatttaaaaccaataaagtaccgaaacagtgtgtagcagacactgttggtgcccccagctgtctgccctgggcactcacttctactcactggaggtagctgctgtctgagggcacctgctatgttctggccctggggctctaggggctggcagtctgagtgcaggaccaagtgtcagagttaatgtccctagaacagcccttatgcaatggcagatgggaacctggcgaatgaacatcccagcttcctaatccctcagctggggtaactcagacgggtctacattggctccccagctccccagtggggttgaactctggtgccctcggaggtcaccagctggtgtcacacctgcattggctgccttcccttctcttccctgctccatcccacatccctgctgatgggtcctgggatcaccacccaaatatatgggaatccctgtcatagggttgtcttttgggggagcccaaaccaagacacagggacaaaaataaaccccacaacttaaaccacacaactgcggtgtgttacatatttacattgaagaaattcacatttttttagtgcagctggacacaaagaacacaaataagcagaatataatttacattataaattacatgctggtagattccctgaggtcaggagttcgcaaccagtctctactaaaaatacaaaaaaatcaaccaggtgtggtggcgggcacctgtaatcccagctactcgggaggctgaggcaggggaattgcttgaaccagggaggtggaggttgcagttagccaagatagcgccactgcactccagcttgggcgacagagcaagactctgtctcaaaatacacacatacgtaaataaataaatacataaaacacacatgtacacacaatgcagctatattatacatacacacacacatgctgtctcctttgtagagaattccaaaagtctatatttgaggctcctccttcatatgaggcccagccaaatgatgcttctgcctcgaatacccctcctagccctgacctcagaattgagggggttgtatttgagttttgtcttaaagtacacatggaaaatacacatttcaggccgggtgtggtggcttactcctgtaatctcagcactttgggaggctgaggcgggcagatcacttgaggtcaggagtttcagaccagcctggtcaacatggtgaaactcagtcccaacaaaaaaatttaaaaactagccagtgtggtagtgcttacctgcagtcccagccactcaggaggctgaggtgggaggattgcctaagctcgggagttcgaggctgcagtgagctatgatcacatcactgcactccagcctgacagtcagagcaagactttgccttaaaaatttttttaaaaattgtctagtagtctagcacagctgctggacagaggggcactgggagtaggattgctagacaaaacacaatatgcccagctagattcgaatttctggtaaacagtgaatactttttagtataaccacatcccaattattgcatgggaccctcttttactaaaaaaagtatttgttgtttatctgaagttcagatgtaactgaacatcctgtatttttattttctaaatctggccaccataactgaaagagagagagagaacagtgagagggaaagcgagacataagaccacagggacacaaaaatggggacagacagagaaatagggacaaatagagaaagaataaaggagagatggacaaacacagatatggccacaagatgcctgcagtaggaaaacagaagaagaggcagaaagggggcagacccagagaccacctcctagactggggaagatagaaggggaacagcccagcgtggacaggggcctagccagagttccttccccaggcaaggctagggagagaagcacctacaggagggcacagttttaaaaaaaattgctgaccaggtgcagtggctcatacctgtaatcccagcactttcggaggctgaggcgggcagatcacgaggtcaggagatggagaccatcctggctaacgtggtgaaaccccatctctacttaaaaaaaaaaatacaaaaacttagctgggtgtggtggcatgcgcctgtagtcccagctactcaggaggctgagacaggagaatcacttgaacccgggagggggaggttgcagtgagctgagatcgcaccactccactccagcctgggtgacagagcaagactcagtctcaaaaaataaataaataaataaaattgctgccagaactctagccataaagtctgcattccagtcaacagaaccaaggaagagtagaagaaaggcacttcctgtaaattgcatccaatctgccagaatttagtcacatgggcacaaccagaggagccgaaaaatgtggtccttaatccaggtggccatgtacccggctaaaatttgaaggttcttttctttttctttttctttttttttgtttttttagagacagggtcttgctctatcacccaggctggagggcagtagcatgatcatggctcactgtagcctcaacctcctgaggctcaagcaatcctcctgtctcagcctcccgagtagctggaaccacaggtgcatgccaccacacccagctattttttttattttttgtggggatggcagtctcaccatgttcccatctggtctcaaactcctggctcaagtaatcctcctgcctcagcctctcaaagtgctgggattacaggtgtgagtcactgagcccaactgaagtctgaagtttctttctttttttttttttttagacagagtcttgctctgttgcccaggctggaatgcagtggcacaatcttggcttgctgcgacctctacctcccaggttcaagtgattatcctgccccagcctcccaagtagctgggactacaggtgcgcaccaccacgcccagctaatttttgtatttttagtagcgacagagtctcgccatgttagccaggctggtctcgaatccctgacctctggtgatccacccgcctcagcctcccaaagtgctgggattacaggcatgagccaccagtcccagacaaagtttctatttttaagaaagaagaggaaaatggatcctgacactgtcccttcatctttcttgctggaatagggatgttttgcctgcaactgtggcatcttttttttttttttttttttttttgatacagagtctcactctgtcacccagggtggagtgcagtggagtgatcttggctcactgcaagctccacctcctgggttcatgccattctcctgcctcagcctcccaagtagcagggactacaggcgcccaccaccaagcctggctaattttgtttttgtatttttagtagagggggtttcaccatgttagccaggatggtcttgatctcctgacctcgtgatccacctgcctcggcctcccaaagtgctgggattacaggcgtgagccagcaactgtggtatctttaaagaccactattgtgcctaccatatagaaacaagtggtcctccaaataactgctgatttaatattaaatccgtaaactctactcaagccagttccattcattcattcattccacaaatagttattaagcgtctactatgtgttctgggcatagagctacgaaaaagacaatgtctctgccttcatggaattcacattctgcctgtggaaggcatgatgataagtgagcaaacacattgtggaaacccaactttcctttaaagatggagcctaataattctccccttgagtgtgagctggacttagccactcacttctcacacgactatgtgtaaaggaaaattgcattctgtctggaactttaccaaatactgttcaccattttaagaccacatcacccatatttatgcctaccatggtatttgagtcaccaaaacagcactcctggtcagactgcatggtgggccactttggaactggtgataaaaattgcttctgctggctgggcgcggtggttcatgcctgtaatcccagcactttgggaggccaaggcgggtggatcacgaggtcaagagattgagaccatcctggtcaacatggtgaaaccccatctttaccaaaaatgcaaaaattagctgggtgtgggggtgcaagcctgtagtctcagctacttgggaggctgaggcaggagaatcacttgaacctgggatgagtaggttgcagtgagccaagatggtgccactgcactccagtctgggcgacagagcaagactccatctcaaaaaacaaacaaacaaaaattgcttctgcttccttcagtctctttccctttttctccctctctctctctcttcctctcattttctcttgggtcactcactctgggaaacaggagataccacagcatgagcacatgcaagcagctctaccgagaggagtggaactgaggcctctgtcccatgagagggagcctctttggaagttgatcctccagccccagttgagcctcatctgactgcagccccagatgacagctcaacagcaatctcaacagatcctgatccagaaacacccatgctgctcccaaattcctgacccacagaaactgtgagataagaaatgtttgcttttaagctgctaagtgtcaggtcatttatcatgcagcaacagataactaatatacagataaataaacaccatcatttaaaattcagttcagtgcaactaacaaaagatgatatggaagcaagtagtggaggtaggagggataaaactgggaggttggtgaccttgtgggtgacattgagttgagggcagagtggtgggaagggggcagccatcagtgctttccaaccctagcagatactacacacccccttttataactgcaaggcctttgttagctgttctgaaatgaaattcataggtaataaaatcttcccacacacagttttaataagactacgaaggtgaaacaaaaggaatgcaatgtataatttgcaaattttatttcaatagataaatgctcagatacaattacactagaaggtgtaatgaagcaggcggatgctggaacctaaaagtgggatcccctggaattgccacagccatatgtgcaggctgattggagtgccctagcagcaaatcagataccatagctggtgtaaatgacagcaatgtggctttgaagtggtaaatgatatttggtaaagttccagacaaaatacatttttctggccaggtgtgctggcttactcctgtaatcccagcactttggaaggtggaggtaggaggatcgcttgagaccaggagtttgagaccaacctgggcaacacagggagaccctatctccacaaaaatatttaacaattagtcaggtacggtggcacacacctgtagtcccagctactctggaggctgaatttggaggatcatttgagcccaagaggtggaggctgcagtgagccatgatcacaccactgcactccagcctgggcaacagagtgagactctgcctcaaaaaaaaaaattgtaaaattagccaggcatggtggcacacatctgtaatcccagcactttgggaggcaaaggtgggaggatcgcttcagccagaagttccagaccagcagggacaacatagggagacccccatctctacaaaaatattttttcaaattagctgggcatggtgttgcatgcttcgatcacaccactgcactccagcctgggtgatggagtgaaaccttgtctcaaaatacatatgtatatatacatatacatatacatatacatatatatttcccttgaattgcaatgatatttgcatttctggaaaatgtggtgatattaaatctacacaagggccgggcatggtggctcacgcctgtaatcccagcactttgggaggccaaggcgggcagatcacttgaggtcaggagttggagaccagcctggccaacatagtgaaacctcgtctctactaaaaatacaaataaaattagccaggcgtggtggcgggtgcctgtaatcccagctactcaggaggctgaggcaggagaatcgcttgaacctgggaggcagaggttgcagtgagtggagatcacaccactgcacttcagcctaggcgacagtgcgagactccatctcaaaacaaacaaacaaacaaacaaaaaaactacagcaaaaaacattttatatgtaaagcagatttagattctaggctcagatcattatcaataagtttttcatctccaggagtgtctggccatgtggcatacattgaattgtttgttacataggattgttcagctctctgcaggatgttatctagcattcctgttccctctattacgacaacagaaatatccccccaacaaaatttcaaaatgcgtctgggggtggtactgccttcatggagaagcactgattaagagggacagaaaaatgtaagacaagcccttgatgggaacaaaaaggagcccagagtggccagagtcctgaagaaaagcaggaaggagatgagctcagagaaaatggcagggcctctatcacaccttgttggccacagtatgatactgaacttggactcaattccaagggcaatagggagcctctgttggattttcggcaggggagtgacatagtctggccttgctgtgtgtgtgtgttggggggagtggggtgggatcaaaacatgttactcagcagactgcactgtactctagagaatttcattcattcattcattcattcaacacataaggattgaggtgtgtctcagtgatctattgctgtgtaacaagcaagaccccagaatgtagtggcataaagtaatgattttttgttttctgctattctgtggctcagctgggcagtttttctgctggtctcactagtcacttgtgctgctgtattcagctggtgggtcggctgggagagctgcaatgactgggctccctatccacgtgctctttcttctggggctgctaccattttgttgttattattgttgttgttgtttgagacagagtcttgctctgtctcccaggctggagggcagaggggcagtcacggctcactacagcctccacctcctgggctcaagcaatcttcccacctcagccctccaagtagctgggactacaggcaggcatcactattcctggataattttttaaattttttgtagcatcagggtcttgatatgttgcccaggctggtctcgaactcctgggctcaagtgatcctcctacttcagcctcccagtgttggaattacaggcatgagccactgacctgcccagggctgcttctgagtgtcattcagcattcccaggcagtaaaggaagaagtgagccagggctgttgatgctctgggacttgtgcagcctcttttctgtcacattctattggtcaagaccagccacaaggctagtctaggttcaggctggtggagaaacaaactctacctcttgctgggagtgactgcgaaatcgcattacaagcagtggaacttgcagaatttaaggccatgaaatattcaacgtgactgtagaccgggccctggggatatggcctgcccctctgcaaccgtgctttagtgagacaacaaatagtcaacacgtacaaaagctcagaaagtgctgtggaaaacatcagctagggagagagggggctacttgagacaggtcagggaaggcttcccagagacgtctgagctaagacccgagcactggagcatgcctgcctgggatgtctgtgcctctgaggtttccaaggaagacaactgtctttgcataagcccatggctgcccttgggggaaggggcccaggggacaccactaatggttgctgtgatagcatcattgtggaatggagtggaagctgccttggggccagagtatctgtcccccagcactcatttgcaggctgtgtgacactggccatctgggtttcttcccctgactcccaaagcccaggtccagttcactgcactgtgagggttcacaggtttataacaggataaactacagagagaggtcagtgcttcctggtatactatgcacagctgcgacactcaataaacagaagttcactgaactgcaaggtcactgctgctgtgacaggagggtcatatggatgtgtgtatcttgccagtggctgtggtgaaaccctgcttgtggagaatagacataaacacaccttctctctctccctctctgtcttcctttcacctcccctctccctccaccccttccatttcctattctcccagcatgttctttccactcttcctcacctccttccccttcacctccttcctacaccattcctttttccatctctttcctgttttcctaacttgttactctcatctttttctttcttttctgttcttcctgacagctccccttcctacctcctctcccttcaccctttctcctactctttcccctcctctcatttctacctctctttccttttcacttcccctctccctcctgtctttctcctttttcttttacctctgtgcctccctctcacctcttcccacaccacctcatctcctccataactaactcacctcctttttgtttgtttgttttttgagacagggtctccttctgtggcccaggctggagtgcagtggtgccatcacagctcactgcggcctcaacctccgaggctcaagcgatcctcccacctcagcctccccagtagctgggaccacaagcagcgccaccaggcccggctgttttactttttattttgtagagaaagggtctccctatgttgcccaggctggtctcgaactcctgggctcaagcgatgctcccgccttggcctccggaagcgctgggattagaggcgtgagccgccgcgccgggcctccccccttcccctccgccgccgccttctcatcgcccttcctccttcctcctgacgccccttactcccgatcacttctcattcattcaccagcttccagtcctcgctccctcacctcttttctttcctactcgccttctcctcctgcccctttatcatctctccttgtcaccgttcttttttgccaatcctctcgttccccttcctttcctcatctcctctcttacccacgtcatctccattctcgtgctccccttcacctcccgttaccttgcgcttctctcctctcatctccatcaccacctctccccgctttcgcctttctttagcccccgcgtcccctatacccttcgcccatgcccactcccctccccaccttctcttcttccaccctccaccctcgccttctgtctctcgcccacctgactccgctccgcccccagccttaggctccgccccgctgggggtcacggggccgacggacgctaggcggccgtagcggcctcgccagtcacgtggtcacgtgacgcgctccaacatggcggcgccgtggggccgaggtgtcgcttcctgacggggcggcgcggacggacgcggccggtgccggccgggacgccgggcccgcagcctagctcgccatctcgctcacgccgcccgcccgcggggccgtcagcccccgccgggccggggccatgcaggagagccagaccaagagcatgttcgtgtcccgggccctggagaagatcctagccgacaaggaggtgaagcggccccagcactcccagctgcgcagggcctgccaggtggcgctcggtgggtgagccgctcccgccctgccccgcgctggcctcagcacgtcggccgttgccctatcctactcggccttggcccggcctcctggcctccgcttccccccgatcccgaattccacccttccggcctcctcctcattatacccccggaggaagtgttgcccgggcagctcgggactggcccaaggtcacctagcaagttggtgacaaccagagcttgttcctcagggttccagctcagggcttttgccacgattccttgtcgccctgtttcctggttcctcccctcaccacctccaagtcctagaaacagtagcccttgccccaagttttttcgttacctgagctctgctgattggggttcccctaggtgaacagagcatgtaggaagagccgtccaactggtttagggaaacccctgattcttgttttggaagtgcccgttggagaatgttttcctttggtttggggatctcccatagctctttccctcaaggaaggattgtagaaggtgttctggatctcccaggcattgtagtgagcaagacatctgcttattcctagcagtccactaaaatacaaggtcttcagcgcgaagatacttgtctgacttattcattgctgtatcccttgcgcttgcaacagtgcctggcgcacagtaggtgctcgataaatatttgctgattgaatggaccctcagattatggaaagagggagaattctaactaatagttaaaggcttgataattgatagcaaaatcactatcctatctttcagttttaatcatttaacaaatatttatcaagtgcccactgcataccaggtactgagaattcagtggggaacaagacggacatggtccttacccctatggagcttatactcgaatagaggagacaaaataattaattaagaaaataggtgaggtattttggaatactgataaatactattttgaaaataaaacagcaagatgtgataaagagggcttgaggactgctttccatggtcaggaaagtaatcttttccaagaggaaaagtaatcaggtggtcaggaaagtaatcttttccaagagggtgacacttgagctgaatactgaaaggcaagaactatccaccatatggagtttcagaagagagttcttggtgggagaatccatgcatttgaccagagctgttttcaagctaattcactgccccaacgtctttggtttggaatctgtaaaggcctgtttttcctaacaaaatgagcaaatggaaagtttgatttttagtcacatagtttgagattgttatcacctttctcctttcatttgctacaaagtatagagtagtgttcttttggcatttagaaataggctggtgaactttgcacttccctggaaagaaggtccctggctttcatcagattttcagagggccctgagactccctcaggggccaactattgatgcagaggtggtagtctagataatctggaaacagttgctagtccgtgaaattcaggatcagtggaaggaatttactgagatgtagatttttaaagcttttctcttccaataaccaaggctgttgggtattttatcagcaatgtgggataagcactgcaaagcagtttgttaggcaagagcctggtatttataactccacgttgaaatctgcctggactctatcttctcgatattgttgtggaggtttcagaatagttatttggcagaagagtttttattttttcttcagaaaacttcttaacataaaattttcaccaaagtgtgcatcatattattggaacctacttataaaattttcatctgggtcatgaagggccattaacgctgagaatttaatagatattttcggatcgtatctttgttcagaagttcaagttttcctaacacaagtagtggaatgcatgttttcagtttttagtagtgaattgtaaaaaatggcctagataggaagtaatttgactacaggttatatgaatcacaaattggggttgtgccaatggcataataggaactgtcataagggaacgtatgcatattgttaagtgaccatcttttttaagagaataattgtgtgtcattgctgttaaatagaaatgactgcttttacttagagtagaacacatagcagaatgcctggtgatatttctctctgtctctcaaggcccagtcttgtgtccagtagtcccatttaagaagagaaatttggggccaggtgcggtggctcacgcctgtaatcccagcactttaggaggctgaggcaggcagatcacgaggtcaggagatcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataatcttcaacctttcagccctctgttggagaatataattacattcttaaacctcccttttataattgtcttatttaagactcatcttctcccatcatgtatctttaagttatgtttctgctcttaaactatatgaagtttggaggcttaataggataatctatttaaaattcgatatggaaaaatttatctatggctgggcactgtggttcatgcctgtaattccagcgctttaggaggccaaggtgggcagattgcatgagcccaggagtttgagaccagcctgtgcaacatggcaaaaccccatctctaaaaaaatatataaaaattagctgggtgtggtagtgcatgcctgtagtcccggctacttgggaggctgaggtgggaggatgacttgaacctaggaaatggaggttgcagtgagttgagatcatgccattgcactccagccgagacagcagggtgagaccctcacacaaaagtgctaagtaatggctaggtgctctataattactagttgtcattattctcagccattatcaagaaaatttaaaaagaatagtaaacatacgtattttcatatgaaattgaatgacttttaaagatcacatgttgtattatatctcctatgtactaagcatttctgagttccaggcacagtaaagtgggcttttcatgcaatttagttctcactattatcatcattcccactgaggcccagagaagttaagttggccagggtaactcagtaagtgatggaaccagggtataaacacaggcaatctggctccatagtccaagatcttaactattactaccatgttttcttgcttctccatatgaaagttgttatgtttgaaatactcagtagagtttttaaaacaatcagtataccgcagtggagtttcaggagactgtattttctatagctgaattttgagatatgtttgaaagccttgagtcaaaaagatcacagctcttttcttcaggtttttactacatatatactaggtttactttaattaggggctaatggaaagaaggaaatgagagtaaagagctggttacacataagtttcatttgagttattcagtttttcttttttttttttgagacaggatcttgctctgtggcccaggctggagtgcagtggtggggtgcgatctcaggtcactgcaacctctccatccctggctcaggtgatcctcccatttcagcctcccaagtagctaggactacaggggcgtaccacccacctggctaatttttctgtttttagtagagacggggtttttctgttgtctgggctggagttaatcagtttttctaattgatgatatctcttcatcagcagtaaactccctcttattaattctggagttgtgacctgttattaattctggattgtgattcatttctttgggtacagcaggcaatgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagaggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaacttgaaaaatataaaaaacatctctaaattgatgtaacgtggcggggcatggtggctcacgcctgtaatctcagtactttgggaggtcgaggcgggcggctcagttgaggccaggggttcaagactagcctggccaaaatggcgaaaccccatctgtactaaaatacaaaaattagctgggcgtggtggcgcacacccgtaatcccagctacttgggaggctgaggcaggagaattgcttgaacccgggaggtggaggttgcagtgagccaagatggcgccactgcactccagccttggcaacagagcgagactctgtctcaaaaaaaaaaaaattaaaaaataaataaataaattgacataacaagactttaaattgaaatgcagaataaagcctttaattttagcaaattctagtgttttgatgagacatttcgtttataagtgctatgtatcataaaaattttgagaaataacaggactcaggaccctggaagattactttttgttgaaaaccactgtggattcttcaggaggaggttatctgtctggaagcagcatcaaaaaactggattgttcttgattattgaaaagcatttatatgtaggattggcagagagttgattgagactttgaaagtttgatttgcttattgatagtccagtgatccctctttgggccgcagtttcccaaggtgataaagatagtaatacctttgtcacaggattattgcaaaggttaaatggactagtgcagtaagtaactggcacagtacctggcacctaacagatgacctgctgaaattcagaggcattggtgttgcaatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaatctttttttttttgagccagtctcgctctgtcgcccaggctggagtgcagtggcgtgatctcggctcactgcaagctctgcctcctgggttcacgccattctcctgcctcagcctcccaagtagctgggaccacaggcgcccgccaccacacccagctaattttttgtatttttagtagagacggggtttcaccgtgttagccaggatggtttcgatctcctgacctcgtgatctgcccgcctcagcctcctaaagtgctgggattacaggcgtgagccactgcgcccagccggtgttgcagtctttaaaggaaaaggaactgaatgcttgcctttctctacctcccctattagttggtttatagacctttttgtaagtctccaacatgagtgaagcagtggttggatagaatgaatttagagctctatcctgtacttgtaaatctcaggggagagtctgaaagcagtgctagggaaaacagtaagaccattcttcatgaaaaagagtgaacttgtgaaaatgtgtacttaatcagcaagaacatggagtgtcctatataaatagctcagagctgtgtttagctcttgccagtttcaccaggcttagggggcctgccaggaaaatacttgactttctttccagcaaggttatcctagaaaaaatagttttgcatttgctgattcatttctgaaattttccagtgagaagctcatttctgtttagtgccttgggtgtaaacaagccttctggcttgatattttattaggttttatacctttgtgaggagaacagccttcttgtgctaggacacaaaattcttaagttttccttccgtcctagggagtggtcagtgtatatttgtcgttctgaatatagcccttttgcctgttgactaaaccagacccaacatttattcagaagatatttatttgggtgtcacccctggtgtcatgatgcagagggatcaaaacaaacaaggaccatgttctgaaggagtttgcagttgaatggggtagatgggcattgttcagaggatatgccctctaggtcataataacaacccgagaagtactgaaggaaagaaacctggttctgccagggcagtgaacagtggggtgagggaagacttccctgaggaagtctcactcattcattgagaattaatgatgagtgagaattaagtagttgggggcaggaggcatttcagcagagggaacaacctgagtgaaggctctatggcagagaggaaaacagttgttggggaaactgaaagaggccagtgtgtggttggaacattgtacttgagcaaagagagtggagatggagtgggagtgggagaggtaggccaagaccccaacatgcaaggcctggaggtcatggctaggagttttattttttaggtcaaaggcagtgagatgacactgaagagttttaaaccgggaagcaggtgataggatgaccaggtgtattattttggaaaaatcatttggaccactgtgttcagaacatcttaggggaagaccagagggattgccaaggaaccaatgaagagactgtcttagtccattttgtgctgctttaacagaatgctactcactgggcgatttataaagaacagaagtttatttggctcacagtccaagagcatggcactagcatctggccagggtcatcctatggcggaaggcgagagaggaaatgggggttgaactcatctttttatcaggagcacactcatgcagtaacgtattagtccattcatgagggcagagccctcgtgacctaatcacttcttaaaggctccactcttacaccatcacagtggcaattaatttgcagcagagttttggtagggacattcaaaccatcgcaggcagttaccattgttcaggtgagagatattggtggcctggactagtggtgacagtagaaatagagcaaagaaaatgaatttccaacctggttagaagatgaagccaacaaaaccttgtgatggagcgagtaagagcatgggaaagaggattgataagcttgactctccgatttctgactcacccagctgggtggatggtgcctattttttaagatgggaatgtgggaagaggactacatggagtggtggagggaggaagttgatctgagttgggacttggatgtgtggagtttggtctgcctttgagcattcagttggacatgtgaaatgggaagtggccagttgtatgagcctgatgttcataagagaggtctgggcttaagataggaatttgggagtcagcagagtctaggtgggaatgggaagcctggtgagacggtatacagagggagaggcaggaggcctgggcctgagaaccctccaggccttttctggctgggcagaggaggctgagtctgcagacgaaatagagcagagatgggtaagaagcggaggaaagatgaggaaaatatgtggttatgaagcccgaagtcgagaaaatttgagagtgaggtcagtaaggtgaaatgctacagagaggtcaagtgaggtaaagactggaaaaatgcccatcagatttagagacatgtgggtcattggtggccttagcttgagctgttttggtggcatgatggaggtgaaagccagactggcgtgggaggtgaggaaacagacggtgaacatagacaactctttcccgaaggttggctgtgggaggagggagatgtggatgttaaaagtattttgttttttcttttttttaaggtagaagagacttgaacttgtttaaatgtcattggggagggagccagttcaaggagaggtttggtaatgcagaaagaagaaaggacagtgtttcattttttcaacaaatgttgagtgcctgccactctgtgctgaagaattctcagtacttgggaattcagcagtgaacagaacaggcaaagtgtctgttgtcatagagtttatgttctgctggggaaggcagatagtaaatgaactgatatataatatgtcaagggtgataaatactaaaaaaagactaaaaaaatgaattagtaaagtgagagaacaaaccaggtaaggagatacagggtgacaagggggtggcagtattaggtgctgaggaagtcccctgaggaggacatcagagcagagatctgaaggaagtgagggggtgagccatggagatatctggggggagggagggcattcccaggagcaggaatagctcatgcaaaggccccggggcagaaatgtgcttggtgtgttcgagcaagtaggccagggccagggtggtagaaggtgagagcagagggatagcaggggccagatcacatagaggtttggaggccaagatcgagagttttaattttacgcggagtgggatggaaagctactggagcattttgagcaaaggagtgttgtgatctgagttacattttgagggcatccctctggctgctgttgagaaaagctgtggggtggaagggaggataattgctgaagcatggagaccagttacaagaccattgtgatggcccaggtgggagataacagttgcttggcctagggtgatagtggtggcctagtgtggtaagaagggatcaggttctagatattatggatagtgtgaagttcctgagaaggcggatagggatgggaggtgacagaggtggaggggttggacacccactcccttatagcaggagagagcagagagtaggcccgaagtgggtcaggttgtaggtttgctaacagcaagctgagggagtctccttgtgcccacttctaatttctgagtgaagtaggaggccactccattggttgtgagtaaagaggacggcagcagaacagcgatgattgggaggggagagttgggccattgagggtggagaaatgtgcagtagccatcgtggagagtgagaggtgaccaaattactgggcagcatttcaggtttcattcgtggtgggtaattggggctctgtaggcctgccaacctgccctgttgtcagaggtctgcttaggcggagacaggtgaaaaggggacgctagtacaatctaagtttgggattttgccagaagttaagactaaaggtcagagagagtccaggctattgattgcgtgtcatctgataatagtcctgctgatgggatctaccctggaaaatgaggaaaaaggaaagccgagaggttggccatctcaaggtttgacaggacaaagacaggttctactgggagcaattgagagggtcagctggaaggagagaagaggaaggagctggaagttccccagttccatatagggacaagagtcagtgtgaccagcctcaccaggctggcttggagtggaggaggatgtggtaggtgactgggagctaaaggaatttaggggcagcgttggtttctgtgggggaagcctgcgacagatagaagtctgaggagtgtggaagggttactgtgggatctgggggcattggccactgatgggattgttgggcagtgctgggtttgaggttggtgatggtgattgttggacttgccttgggagtggaagagagaatgcgagccagtgtcagaggtgctggtgaatggaggtgtgtgacccgagcggtaacatccagaaaggatttcccgcaaagacagcgcggcttttcagctgcagctgccccaccctgctccagtctccctcatttccagcctggaaattgttgctaattgccccattggcagttgggaaggcaacgcctgttaagatgtggagcaataaagtggagcaggtatgctgtgccgtatgcccctcttcctgcaccgtcctccttctgtcatcgttgagtggctcaggagtgctggccctctaacagactgcctgggcgtggatcctgactgcagagtagcacttctggctgtgacgtgggcagatggcttaacctccctgtgctcagattcctcacctgtaaaacagttaatggatgattagagtgttcctgcctccctgggttgtggtgaggactgaatgagcacctgccactaggaggcaatcagtgagtcagctatcatcattattattattagggttccactcattctccttttcccttggcattgcttgatcccacggagatcccactagagattttgctttaatactgacttgttttaaaataagagcaagagaactgacatttattgaccacctgctgtgtgccagctgccgccttagtcaccaccaagacctctctcatggcggtgtcaagagaattatctgcactcttggtgcctagttatggtctctggagcatgtggggctgttttttatcactcccattttttagaataggaaatcaagattcagggaagttggccgggtgcggtggctcatgcctgtaatcccagcactttggaaggctgaggcgggtgtgtcacctggggtcaggagttcaagaactgcctggccaacatggcgaaaccctgtctctactaaaaatataaaaattaaccgggcatggtggcacgtgcctgtagtcccagctatttgggaggctgaggcaggagaatctcttgaacccaggaggcggaggttgcagtgagccaagaaggcgccactgcactccagcctgggcaacagagtgggacttcatctcaaaaaaaaaaaaaaaaaaaaaaaaagattcagggaagtttaataacccaataacccatctggcatcattcagctaatagatgtctgtgccaggacttgaacccagctctgtctcacacctgtatcttttctttctgccatatcaggctgtgccatgctatctgtgaggcaccctgccacacacactttttcgctgttcctttttctccctccgtttaaaaaaaaaattattacacttttaacttctgggatacatgtgcagaacaagcaggtttgttacataggtgtacgtgtgccatggtggtttgctgcacccatcaacccgtaatctgggttttcagcccagcatgtattaggtatttgtcctaatgctcttccttccccttgcctcccacccctcaacaggccctggtgtgtgatgtgtgcctccctgtgtccatgtgttctcattgttcagctcccacttatgagtgagaacatgtggtgtttggttttctgttcctatgttagtttgctgagaatgatggcttccagcctcatccatgtccctgcaaaggacatgaactcattcttttttatggttgcatagtagtccatggtgtatatgtgccacattttctttatccagtctatcattaatgggcattcgggttggttccaagtctttgctattgtgaatagtgctgcagtaaacatacatgtgcatgtgtctttatagtataatgatttgtaatcctttgggtatatacccagtgatgggattgctgggtcaaatggtattcctcattctagatccttgaggaatcgccacactgtcttccacaatggttgaactaatttacactcccaccaacagtgtaaaagcgttcctatttctccacatcctctccagcatctgttgtttcctgacttgttaatgattgccattctaactggcgtgagatggtatctcgttgtggttttgatttgcatttctctctttttttctttttttattgatcattcttgggtgtttctcgcagggggggatttggcagggtcacaggacaatagtggagggaaggtcagcagataaacaagtgaacaaaggtccctggttttcctaggcagaggaccctgcggccttccgcagtgtttgtgtccctgggtacttgagattagggagtggtgatgactcttaaggagcttgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccactgtcatcatggcccgttctcaatgagctgttgggtacaccttgcagacggggtggtggccgggcagaggggctcctcacttcccagtaggggcggccgggcagaggcgcccctcacctcctggacggggcggctagccgggcggggggctgacacccccacctccctcccggacagggcggctggctgggcggggggctgacccccccacctccctcccggacggggcggctggccgggcggggggctgaccccccaacctccctcccggacggggcggctggccgggcagaggagctccttacttcccagtaggggcggccgggcagaggcacccctcacttcccgcatggggcggctggccgggggggggggctgacccccctacctccctcccggacggggcggctggccgggcagaggggctcctcacttcccagtaggggcggccgggcagaggcgcccctcacttcccgcatggggcggctggccgggccgggggctgaacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcggggggctgacccccccacccctgccggacggggcggctggccaggcggggggctgaccccccccacctccctcccggacggggcggctggctgggcggggggctgacccccccacctccctcccggacgaggtggctgccgggtggagatgctcctcacttcccagacggggtggctgctgggcggaggggctcctcacttctcagacggggcggctgccgggcggaggggctcctcacttctcggacggggcggttgccgggcagagggtctcctcacttctctcttttttttttgagacggagtttccctcttgttgcccaggctggagtgcattggcatgatctcagctcactgcgccctttgcctccagggttcaagcagttctcctgcctcagcttcctgagtagctgggactacaggcgtgcaccaccacgcccagctaatttttttatatttttagtagagatggggtttctctatgttggccaggctggttttgaactccctacctcaggtgatctgcctgcctgggcctcccaaagtgctgggattacaggcatgagccaccacatcgggccttgatttacgtttctctaatgaccagagatgatgagctgtttttcatatgttttttggccacataaatgtcttcttttgagaagtgtctgttcatatccttcgcccattttttgttgggattgttcttccctcttttaatggaaaaaaaaaagattgcattatccagatatatcaagaacccaacttttaggttgggccatatgagactactgctatttgagcatttccagcctgggtgagagggtgagactctgtctccaaaacaaaaacaaaaggtgctggtgtgcttcagactgtgccttctctccacctgcacgggctctgtcctgctctaagcccccattgctgctaggctggattattagcagtaacttcctgattggtttccctgcttctgtcctggccaccttcctctttatcctcacagcagccagagtgatctgtccgaagaaaagttgagtcaggccgccctctcccagcccctccatgggcttcctcccatcccttacaaagatgccgttatcatctgggcccctactgggcctagtggagaagacttttcaagagtgtctttctttctttatttcttttttattagatggactccaagtctttttaccatgttgctcaggctggtctgagctcctgagcttaaactgatctgcccacctcagcctcccaaagtgctgggattacaggcgtgagccactgggactggcctcaagatttttttttcttcaacaaaagagtagtttagaaagtgcagcaattcctaattcttgtgggaatacttaagggtaaatttagaaaaccaaagaaaatctgtgaacataggatttgcaactggagtttcttgggtttctgcagttactcttccaggtagcaactctttcctggtcacaggagagggctgctctcttcggtccctgtgccctgcactgctgctgctgccagtcctgtcaacgcttgctcattcccattccaaaaccaggttttacctttgctgtggtcatgccaggccagaaacagactttggagatttcagaaggcttgtaaactagccttcccagctggatgggttcacagagcagtaaaacaccagtgttttgaaccgtggttgtagctttcatggttagtgtcagtgctaggaaaaccacacatttaaactcttctgcatttatggtttacagagtaattccatatgcttgttcgagagtcgaggtatccaggagaacacagactctggagcctgattttctgggtttaagtcccatctccagtacttaataacttgtaacctctgtggatcttgattttcatctataaaatttataatggagtttggccttgaacttcagtcctctggctccttagttctttgttctttggctggacaacatttcgcttatagaaaacttgatgttttgtcctcatagcactgatcacagtccttaaaagccacttttagcccctgcagctacttttctgcagccactgaagcactttctcctcggctcttctccatcccttaaagcaaaattggcaaaccggtagcctcagggctaggcagcttgcaaaccagtcttatttaagccataatattttttaaatatatttttattgatacatatagctgtacatatttttgaggtgcattgataattggatgctttcatatagtcaaatcagggtagctgggatatccatcactttaaatatttattttttctttatattaggaacatttgaattattctttcctagctattttgaaatgtacagttggttaatgttaactgtagtcatcctactgatctaacgaacaccagatcttattttttctatttaacataattttaaaacaattgaaggtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagaaagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggacttaaacttgactctaacaaggtaatggtgattggaaggaaaacctacatttgagtttgggcagcagcacccctctggcatgtcacagtgacatatcttgtcacccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattgctacttccagtgagtcagtttacttggttttcacatcttcaagttgagtctagaatggagttacctaagaaaaggaaatttgcagccttcagtaccgtgtcctggggttgctagaataactagtgccatatccactctactggctctctagagattgtgtaaaggaggctggccttttggagatgatctgaatacatggtattgaggacaaacctccttcccaaggctgatttgataatatgtgagtttgtgggtctaacatgtagaaatacactcaactgagtggatgtggggtaattctgtgtatttagacagggtgttttgttgttttaatggtacgaaaccttgttttcctggaaataacactatctctgagattgtgatttctgaaaaatgacattttattcctataaccctgccaagggtagtgcaacctctgtggttaagattttaaaattaattttaattcaaaaaagtcacacgtgccttagcacaatgtgaatgtacttaatgccattcaactgtaaacttaaaagatggttaagatggtaaattttaggttatgtatattttattataattgttttaaaaagtgctgattaagaaaaagtatgtatgcttatcatagaaaatgtgaaaaaagaaaaaatcatcatcccactacttagacaactttcaatattttattggtttcaatactttgttatattcgtttccagtcttctatgcatatttgcacacagttgagatgttgtgatattaccatgttattgtgtcagctaactgtcatgaacatgcattctgcagaacaagaaacaggtaagaacgtggctgtagagccagaaagcctcggttcaaattctggctccctagttcttgatgtgcaacagtagccaagttacctaacctcctgtgccttggtttcctcatcaaaatcattgcttctcatcaagagcagttttgctcaggagacacttggcaatgtctacagacgtttttggttttcaagatggcagaggggtcaggggtgctcctggtatccagtggatggaggacagggatgctactaaacatcctagagtgcacagggcagcctcataacaaagaattcttcatccccaaatgtcagtggtgccaaggctgagaaatcctcctctaaatgagatggatataataagagtatggacctcataggatcgttgtgagggctaaatgagctaaaacacttacagtaatgcctagccagtcactccatgtaagtgttagctattattattgctgttacaattatttctttcacttcatatcagcatttttgtatttaaacatctcgttaacaatcttttcagtggtctccaaatatcttttagtaaagttttcctttacataaatgttgcattttcctaatgtgttttttcttccttccttaccagatgaaattaaagcagaaatagaaaagcagaggtaagctatagcactacctccttgctgagatacggcatgaagggagtaggtagcaactgggggagcctctttctctgcttggtttctcatatttctaatcctcaggggtggcacacactctgcaagcatggtgctaggcacacggcacaactctgtgtatgtttgaactgatgctaggttcacaggctactgcctcagtacttgtatacttggaaggaaggatcaagatcgaggtaatgctgttgtatcttttcttaacagaacaggcaaagcccttgtctcttgtatggcctgcttccttaggcatgaggacagcttgcaccatgagtggttactcctgatcttcatagtaaggaaggccgttagtcacgtttcagagatatagctctggcgtggctgccaccaggattcagtccaggatgttgttaattcagcatgccaatcagagaacttgctctctgcatgtggcacttcagtggtgtttttgctaatgcatgtattcaacttttaatgcctagccccaggatatagtttgcaggcactttaaattaaatggttgcagatggaatgggaagttagagtaaggtgtagaaaattcatttcttctcccgaccctctcttgcttttctcctaggcttggcactgctgcaccaccaaaggcaaacttcattgaagctgacaagtattttcttccattcgagctagcttgccagtccaagtccccaagggtagtcagcacatcccttgactgcttgcaggtaccatgtttaaacttcgtgttgtcaagggggttctctccaagccacagttggtccttacacagaactatgctggggaccacgctggcactcagtgctgtcagaggcgatgcagaaaggagcagtttaacgtattctttttggagatctcatgagggagggaaaagagaaaggtgtgagctctttagcttaaaaccagaaattttttcccctagaaatatcttatttgttcatgtcttgtgtatgtttttctaaatgaaacctttagcattaattggaatatttgacacacatgggcacataaggcatttttatacagcctcttttttattttttccattttgtagagatgcagtcttgctatgttgcccaggctggtcttacacttctggcctcaagcagtcctaccaccttggctttccaaagtgctgggtttataggcatgagccaccacacctcctggctcagcctttctttcttacttggtttttttttttttttttttttttttttggagatggaggtttgctcttgttgcccagactggagtgcaatggcgcgacctcagctcactgcaacgtctgcttctcgggttcaagggattctcctgcctcagcctcccgagtagctgagattacatgcacccgccaccaagcccggctaattttttgtatttttagtacagatggggtttcactattttggtcaagctggtctcaaaagcctctttcttaatggcgttaaaattcatatcaagtagagaaatagagacagttgaatctgttgtttttggtagttatgtgctataaagtcacctcccatactgaattagcaaacattgaatctttgttcctggaggaactacagggttaggttcctgcaagcctttagtcttcatgtgtttctatttaaagagactatctaatatctattgttgatgcattaacattgaactcaggggccacggtgctataacacatgcctgaacaaagcttatctaacacacataatttctgtgtgaggcacatcaccaccttcttgctgttaggaacactggaaagcacatcagcacaccctcggggtccattgtaaacagcaaaatcaccaacaaaaagcaccaaaatgcaaaaaacacagcactaactacaccactaaaaagatacttgttttcagtaggagagtgaaacaaggaggcatagtgttgccttgtttgacctcaggaacatgaacatcaagtgatttcaaattttttactgctctgtgcatgtctacaaatgaccaaaaaagccccagacgtattgatttgggcttataaataaattttagtgagtaggtgcatttgcaagtatagctgcaaataatgaagactgactgtatttagagtcacaagtaactttgttataaattaccttttactgaagaagaagcaagagtagagaagttaaggtgacttgtccagtaatatacaggtagtacgagaaacaggactataacttgggtttcttaattcctggcccaccattcttgtacttttgctcaggacctactccttaggtttctgattaccccaaagaacatttattctcttttttgtttattttgagtcagggtctcactctgttgcccaggctgtagtgcagtgccttgataatagctcactagagcctctaactcctgggctcaaacagtcctcctgcctcagcctcccaagtagttgggattataggcatgagccaccacacctggctcaaagaacatttattcttgacctcagtgggcagtccacatcaatgaataaagtttaataaaatttaaaaatatgttgaagtgatccacagcttgccaatactttctagaacaggaatggtgaccagattctgtattctgattgctgtgtagaagaggtgtctgaagaggtgtacagctttctcgagaaagagtactgtgattgattggttttatctaccaaggcacaggactgcaaagtggcagtgagcatgccacatttttggcatctctggtctaatatttactctattaatctctcttctttgttacatgtacttgagaattgatgagagtttcttcacggaaacaactcttccaaatgcaaagccattttgttattcagtgtaattctgtacagattgtcctatgtgagacatacagtgagccaagaattgttaaatggcaggcttcagtcctacttctatcctaaaatattttttgctgtgaacgtgttctgaggagatttggcagaatttgaattttagttgttctctccgcatgttaaggttttcttttgaagggagtgctgataatgtaattgacgttctaagaacagtggctgacatgcattgagctcttagcctgtagtgggccctgtgtgcttcattcaccgtaccgtgtgtagtcccctcgacagccctctgaggtacttactcttgtcctcattttagaatcaaggaaaccaaggcttagggaatgaagtgaccagcctagtccaaggtaggctgcagtgcagtggcgcgatcgtggctcactgcaaagtcaagtgattctccccgggctcaagtgattctcccacctcagcctctcaagtagctgggaccacaggcttgcacaaccacacccagataattttatttttatattttttgtagagacagggtttcaccaagttgcccaggctggtctagaactcctaagctcaagtgatcctcccgcctaggcctcccaaagtttggggattacaaacatgagccactgcacccagtgggtttctaggacttcttgactctgtgtctgtgttcttaaccaggggtcatcagctttggcccatgagccaaatctggcctactgtctgcttttgcaaataaagttttattggaacacagctgtcttagtctgcttgggttggtgtaacagaatatcatagactggatgtcttcaacaacaggcatttatttcttacagttttgaaagctaggcagtataagatcaaggtactggctgatttggttcctggtgagggtacactccttctggctgcagacagctgtgttctcacgtgtcatggagagagagctaggtttctggtttcttcttagaggacactaatcctgtcatgagggacctaccctcatgactgcatctaagcctgattatttctcaaaggcccagcctcctaataccatcacattgcaggcttaaggcttcaacatacaaattttagggggacacaaactttcagtctgtagcaacagctatgcccattcgtttatgtattacctgtggctgccttcctgctactgtgacctagcggagtagctgtaaaggagaccaaatgacccgcagagcctaaacatttagtatgtgttcctttatggaaaaaggttgctgctcttaactggcccctgctcttgactgtacccatgtggttctggcctgtttagtaacagaaatcgtttgtttctggaactccttgcatctgagtatgatttcaaacggaaacacaccctgccttgtttcaacccactgtgaatcttgagtcttatggggtatggttatctctctttttagaatggaagttctggctgggtgcagtggctcacgcctgtaatcccagcactttgaggcaggaggatcacttgaggccaggtatttgagaacagcctgggcaacatattgagaccccatctctacaaagtaaagtaaaaataaaaagttagctgggccatgtggtgcacacctttagtcccagttactcagaaggcagaggcaggagaattgcttgggcccaggaggttgaggctgcagtgagccgtgatggtgacacctaactctagcctgagtgacaaagcaagaccctgtctctttaaaaaaaggaaaaacacacagaaaggaatggaagttctctgagatgtaatagattctctgagatgtaataggtacactaggatttctttgtttagtatacaaaatgagtcatcctttttatgacatgagaaagtggctcggtgctccctgggctactgaatggaaaaaatgtacttccccatggtggctgcccttgccaagcctgtttgactggcttttcccagtgtgggcaaggtaacctctgtcttagaaatggaaggccagcatcggggtaaagtttggtttgggcagaattgaaaccagctgcagatacatcagtgctatgccctgccattccttgagcttggcgcagcagtaggagtggcaaaggtgcttctgggattgatttgccataagcacagttagctcaggcttcctctccactgggagaagcctggagacttcccctgcggcttgcttctaccaggtgaaaaagattctgtcttccctttctccagcatttggtctgctacacgcttccccgcagccagggctcagtgtaaggggggttaaggtcagtcttgtctaagctactaagtagtccccaagtttttctggtcacatatcaattttatatatatatatatatatttttattttttatttttttagagaaagataggtattttttagagaaaggaaacacctttcattctgttacctaggctggagtgcagtggcgtgatcaggcttccgaaaaccccgacttccccaggctcaggtgatcctcccatctcagcctcccaagtagctgggaccacgggctaatttttctattttttgtaaaggcaaggttttgccatgttgtccaggctggtcctgaactcctgagcttaagcccaccttggcttcctaaagtgttaggattacaggcgtgagccactgtgcccagccagtttttttggttttttttagagacagggtctcactctgttgtccagactagagtgcagtggcttgatcatagctcactgcagcctcaaactcctggactcatgtaatcctcccacctcagcctcccgagtagctgggactacaggtgtgtgccgccacacccagctagttattttttttactttttgtagagaccggggtcttactttgttgcccaggctggtctcgaactcctggcctcaagtgaataataaaaccatttttgaggatatcctgccaatatattcatatttctttaatttaaaattataggttagggccaggtgcggtagctcatgcctataatcccagcactttgggaggccgagacgggcagattgcctgagctcaggagttcaagaccagcttgggcaacatggtgagaccccatctctgctaaaaatacaaaaaattagctgggtgtggtagcacatgcctataatcccagctacttgggaggctgaggcaggagaatcacttgaacccaggagatggaggttgcagtgagccaggattgtgtcactgcactccagcctgggcaacagagtgagactctgcctccaaaaattaaaataaagttatgggttgggcatgatggttcacgcctataatcccagtgctttgggaggccaaggtggaaggattgcttgagcccaggagtttgagctcaacatagggagacctcatttctacaaaaacctctttatttacacatgttcctgttattaaagtatatatatggccaggcgcagtagctcacgcctgtaatcccagcactttggaaggccgaggcaggtggattgcctgaactcaggagtttaagaccagcctgggcaacatggggtgcctgtactaaaaatacaaaaaattagccaggcatagtggcatgcgcctgtggttccaactactcaggaggctgaggtgggaggatcacttgagcctgggaggcagaggttgcaatgagcagagatcgtgccactgcactccagcctgggtgacagagtgagaccccatctcaaaataaatatataaataaataaattacatatattgtaaagcatacaaaaatacaactttgacaggacaattggaaaaatataaataaaattctaacattttctttttacatcccagtgaaggctgtaggaaaccattaatctaagctgccctgtttataccataaacattatcttttagctcttatttccagaaaacttttgattttttaaatgcacaatgaaaaatcaatttttaattatgtaagttgtacatgactacagtctctgttaaaaggtttttagaactttacagataaaatgaagttccttgggccaccagccccaaacccaattgcctgtttaggtgtatacttttctttcctctctttttttttcaataagtgatatcacttgtacaagtttctctgcagctttttacattcaacaccgttatcaggctctagctatatctctccatgtggatctagtgcattcttttgactggcatatgacgtgtcatgccaccattccatctctcgctcccctgtacagaggcacacacagggttatagtgaacatctctgtgcaagcctccttggagacatgcctcagtttctctggtcagaggtgactctttggattcctatcactgaggcaaagtaaatagaaccaacttcagaagagaccagtgaggtagaagacttaatttgtaccaaatatattcattcatgtgggtgggataacttgtaatacagcttacttaccctaacctctgtttattacagtacagaggtacagtatgtcctattctgtaccaagaaaccaaccgcatagcattttccttcatgcagtgagtcctataaaggcctgttatagtgtattatattgtcatcatcttcccctccatggcagaatgtccctgtgcaagccctgactcatgtgtcagtgggccagctgcctagaggcctccctccctgtccgtcttcccgccgctcattgcgttagcaaggaacaaggtggggacatctacctgggggatagtgggagatagggggcagtatctacaagtcacacacagccctgtaggtcccagttaggactttgagctttggtgcacctccctggagaatatagactctataagaaaaataattacgtttgtcttactattgtatccccagtgcccagaacagggtctgtcacaaagaaggatgagaaagcagaaccagaaagatccacaggatacaggaactctcctttctcctggccttgtctcactgcacagatgaggggggaagtcatgcttaaaaccctttctgatttgaagagtaatgtgccccttaaggagtctggagaggggaggatactttctgtccttttcatactttagttaaagtgcgaaagtcgtaatccatgtccagcctgctttgtggcatcagtattgcagcctacttttcagcattcacatttgaggagttcctagaccaccccacttgcaatccagtgcacaaaacagacttgagtctgttagatgtaagaacaagcaatgtcaaaaccagagctcattttccaggtagacagccctgccctcctaggaagcctgcacctgcagcagcaatgtgaggggtgaggtaaagggcatctggacttgcccttcacaggccacacccctcacctggagatttgggggttggacttgagcagcagagtgtacgcaggcctctctcctgctccttcagttactccatccagtagtattgcatttctactctcagccactctctcaatccatttttctttctgcttgttgagtggtgacacttcactagctaaggaaggggaaaagccattgagaaacggtgtcggacctttgcagagcggccagtcttcctcccacagtggtggctgctctatagataacctcaggaacctgagtccccctggtgggggcagaagcatgtgaccagtagaagccaaaaaggggaaagaacagaacagcagttttaggagtcttcaccaagtcactggaggcagagaatgccttagagttcacatgtatatgtgccagatgagtgattcttttatctgatcaaccatcaatataacgtggatagcttggagaaaaacactgattcctgggctccacctggaagttctgcttcagtaggtctgggtcggagtccaggaacctgtgtttttagtgagctccctcaggtgattatgtttctcagccaggcttagaaatcatcctgctgctgacctttgaggttccttccagctctgtcctccatgctgacatcccggttgtgtgtgaggtggcacagaccaatttgtaacctctcagagagggcacgttccaagcagctgctcgtgggtgacacacactactattgatgtaggtgtgaaatgcagatgaagtttttacattaatttttggggtagaaaatacactgacaggattcaacgttgaaaaaaatgaaaagatgtactacagagtgtcttagtcccaccccagctcacagctacttagttctcctccctcaagcaaccatgttattagtttcttaggtatctttccattgaaagaaaatacatattcatatatatatataattttaacagctttttgagataaaattaacatgcatacaattcatccatttaaagtgtaattcaagccaggcgcggtggctcacatctgtaattccaacactttgagattacaggcaggaggatcgcttgagcccaagagtttgggaccaatctgagcaatatagcaagaccccatctctacaaagaataaagaaaaattagactagcttggtggcatgtgcctgtggtcccagctactcaagaggctgaggtaggaggattgcttgagcctgggaggtggaggcatcagtgagccatgaccgtaccacttcattccagcctaggtaacagaataagaccctgtctaaaaaaaaaaaaaaaaaatatatatatatatatatatatatatatatatatatgtatgtatatacatgcacacacacacacacacacaaaattttgtgatttttagtttattgacagagttgtgcaaccattaccacaacctaactttagaccatttttatgttatcattgacgatcactccctatgtctccctacgccgcccccctaactctagacaaccactaatctctctgtcttgagtatgtgtagctattaattcctcaggcttgcagagatggttgcgtactggggagtgctctataccttgcatttttcatcggatactgtatcaccattccaggcatcttttgctgtcaggcgacaggacgaaggttgcagtcacagagtggttatgcctgcctggctcctggggagcagaggactctgtaggaactggaagtgcctgtcttttgctcttgtgggctgccacggaaggcctcagtcctagccaagcagaaatgtataatctctgttctttctctctttagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggtatgcctatttgtttgcctgtctggtttttaaattagaaagcaagtccctgtgggaatctggatttctaatttactatgtgttagttgtctcaggtggtgctgaggtggaacagaaagatttaagcgtcacttagatcttttgttaggtgtcagaatttattagcgtggactgagacaagaaaaatggaaccaggtgtgttttcaaagtaaactgttcagctaataacaatgtaaatttcttgtgaattaaatcgtcttgaaatcctctggttaaccctggattcccagtctgggtttctcagtgggtctttgttgatattcttatctctgacttgcctctgtcctacttccctgttcgatttctgctgccaggaatggtttggcacagatagtaccatctgcttgtctgagaacaggatcaggacaggtgtagccaaggatccaaatattaagtcctgaaagtattaacattatgaggggagggctccatgctagataaacctttcttaaagctcccttgaaaacccactagggaattgggaaactgaccacatcgaaacgtatattttctgattaatctgggtgagatcacgttggagtgttatatgtcatgagataattgtctgtattattcattttaggtttttcagtcagtatgaaaattcagaagtttggcctttttttttttttttttttttttttgagacatagtcttgctctgtcgcctaggctggagtgcagtggtgcaatctcggctcgctgcaaactccacctcacaggttcaagcagttcttgttcctcatcctcccgagtagctgggactacaggtgtgtgccaccactcctggactatttttatatttttaatagagatggggttttaccatgttggccaggctggtcttgaactcgtgacctcaagtgagccaccctgcctggctggaagtttggctttttaaaaagtgagccagtagaaagcctgcttcaacacaatttaattgtttcgagtgatttggatttcatagaactgttcattgtttttcaactaacagccataggagttggctcttcataataatcacctagtttaatttgcagagccatcttacaatttatttgaaaaaagcacacagaaaagaaaaacaaaaccagaccctctagaaaagtgtggccataggagggcaggaaggtgatgtgcgttcctgatggtgaaggtcgcggatttctattttaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtggtgagtgacagcacttacgtgctaggggcaagacatcattgctctctgaactctatcatgtgtgaccttggtgcctgtgaagaatcactagcattttaaagctaccccttcttcctgtggattctctgtactgtgcttttgttcttgctttaaaaatcagagaaactaaagggttttgaaatttgtgttcagaatttgtttggagactgtcaaaggaatttatttccttttaaatatgttatccttttggctggaatttttctttctttctttctttctttttttttttttcttttttctttttttttggagagagggtcttgttctgttatccaagctggagcgcagtgacaggatcatggctcactgcaggcttgaccttcccagctcaagcaatcttcccacctcaacctcccaagtagctgggactacaggcatgtgccaccacacccagctaatttttttattttctatagagacagagtttcaccatgttgcccaggttggtctcgaactcctgggttcaagaattcctgctgcctcagccttccaaagtgctgaaattataggcgttaaccaccgcgcccagcccaggaaattttttaagtaataggctggcataatttttcttccttaccaaaatgctgtatcccccttttgttgccttttagttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcaggtacgggctgatacggtatggctctttttccaagtgtgagagggaatcagcctgtgaggggcagaagaagtgtatgtcataacatctgaaggaaacctctgataacagcttatctctttctgggcctttccctttgcttttctcttagggaacacaaccagtgaggcatgatgtcaagtgtcccgttgtcagctgtgctgttttctctaaatagtactgggatgtatctagctgctacttcttcatgtcagcctcagtgcaacaggttcaggttgggacacttatctttcagtagttaattgattgggtgattagtcactcagtgtccacaggaggacaagggcttagattctcatgtctacactggatctccatgccttgcccagtgcctagcagtagccactcatagatatccatggaaggagccagaaggtagcaggtggatggacggatagacagatggacagatagctttgttttcttcttctggtgaccatgtacatcacttgtttttgttgggtttttaagtgagagactaacccacacctgattatattcttaaagtaaatgaaatgaaatactggattgagttgttataagatgatacttctgactgttcatatctctccctgggcagtttgtaggaaccagatccaaaattggtattttttcaggaatttcctttcccaagtgattctgtcaaatgcttcttcactcaagcaggttgttctatacaaaatatctgacctgtcttcataactgatctcatttcttcttcagccacattactgataatgatttctgttggtagtatgttccctactggagtgcacatatttgagcaggttttattcctttataatttaccagactgcttgatgtacatgagaacagaccaagtgttgttgctggaatgttgtttggtattcatttactcaaggaaagcacaaaagaaaaaattgccaccaagaatggtgttgtgtctcagggtgagcacggagttgccttctacttacttctgctgtcgagagtcctaaggaaggtgctcagaatcccccggcccaccctctgtgtctgttatcatctttgcctttgtaactctctagggaaaggaccaggtttttactgtaacccttattaagctgtgatcagtcaataaatattaatatttaaatacactgtaataagcatagctgtgcagatataaaaccaagtctctctgacctgcataaaagtgcttccactttagcccattttctgtacagcagccaaagtgatctcttaaaagcgtgaattagagcatgacccctgctcaaacccctttggtaattccccatcctgtgccattctgactgaaatccatgccctgtcctcatagcttatacctctctttctcttttttgctacacagtgcacaggtgccctttctggttattgaacggctgtgcttgtttctccctcagtgcctttgcacttactgtcccttccctgcctctgaaccccttgtatcttcaggtctctcagttcagactgagagaggcttctctgatcaacttctgtagctcctcatcatatctgtcccattatcttttatttttttccatagtacttacaatacctgaaattactgaagggttctgttcacttgttcctgcactgaagcctaggctgccctgctcaccaccatattcccaacacctagaatggtgcctggcacacgcagcagacattgagcaaatacattttttgaatgaatggggaaaaaacgttattgctagaacataattttgtagaaacgcagtaacttgaagttctgctctaacaaagagaaaataatttgctgttagcatgttgctgtggattttgtggccaatacttggtgcatcctgtgagactttcccaggaacatgggaatcagattgcctgggagaagcaaaccccagacctgcaaatagtgggtcagaacggaagtgtgctgttacctttaaaaagagcaagtgggctgggtgccatggcacacacctgtattcccagttacttgggaggttgaggcaagaggatcacttgaggccaggagtttgaggctgcagtgtgtctgtgaatagcctctgtgctccagcctaggcaacaaaacaagaccccctctctaaataaataaacaccccatctctaaatcagtcagtcaatcttaaaggagcaaatgacttccagttctcaggactaggctctaaagaaagaacaggtccttcagaagagggagttgaacaagggagacacgtacccaggggcggagtccaggcatcaaggcccagtgaaaggcctgagctctagtgcctctgtggctattatttttacatattactaaagtgcatggatgttggacacaaccatggggctctcccacagactgtcctgtagtaatcaccatcacatggccaaccctaactggacactcactgtactgctgacttggcattcaacataatgttttccaatttaattaactgggaatcccccccacagccttcctaggataatttgcctcccatgttatttgtgtagatgaagagaattcaccaatagacctggacatctgtggtggctcacgcctccaatcccagcactttgggaggccaaggcaggcgggccacttgaggccaggagttaaagtttgtttttaggattctgacttttaactcccagcatcagacatcagtgtgtgtacatttttacagatactgtgtagaattacctatgtgtttgtgtggatttcttagctcactttttgcatctttttttttgagaatgagtctcgccatcttgcccaggctgtagtgcagtggtgagatcttggctcactgcaacctctgcctctgcctcccaggttcaagtgattcccctgcctcagcctcccgagtagctgggaccacaggctcacaccaccacgtctggctaattttgtattttttagtagaaacggagtttcaccatgttggccaggctgatctcgaactcctgacctcaggtgatccacccgtctcggcctcccaaagtaatgggattacaggcgtgagccaccacgcccaaccaggatctttgttttagacagcaatatgttccaaatgcctggaactgtgccggacacatacacactcagtttgttgattgaatgaatcttaccgccccaccatcccccatgctccctatttaactggacagagaacagggatgtggggaggccttatctcagactcctcccattttttccccgttattcttagcatgtgacttctatccttagggtcatcttatggctcaggatcctgtcattttgttccaggtaggaagaaagaggaagagataggactgaagaactctgccagctgagtcaccccccttctaaagaggagtcttctggagcttgttgccaaccctgataacttatgcttacccctcattggctataacttcatcacatgatcaccctttctgcaagaaaggctgagaaatgtaggcacattccctcccaaaacaaaattcaggatctgttaggaaggatatgagttagagaactggcagtgcctgccacagagtgttctccagctggctagggagggaatggcagcaaggtttctcctatgtgagcctattcaaggtggccctcttattttgcttcggggcagagtctgaaacagatagggtctggtgcctaatcagtagtggtggtgatatcccagggaagagcagaaccagtggtttttaagtagattctttgtacctctcaaaggtttgatttgatttaattatcaaacactttcacagcatgcttgaaacttagatacaatggacttagtagtggttatcacaacatccagaaaagcctcttctgagacctatccaaggctgtcatgtcagcaggggaagcagtccacagttactgggtggagtcttcctgctttggggcctctactgggatttttccttagcagctccctcttcaggaaccttctgctggtattcgggctttctgactctccttagctcttcctggcctgagaatgttttgattttgcataagtactattatggatcctgcctattaaggaatatgagttatatactctatccctccaaaaaacgttgctcttgatgctgtttaaatggaaaaactgcagtgagggaaagaggagatccatgctgatgtgaaattttgtttttctccttaggaatgaaagatagtgaaggttttaactaactggaactacttgcagtgtgattcgttggaaattttcattatggatttagtctgcagggccaggcgggtgacagaaatgagcaggcttctatcatgaggacatcataaatgtcttcacacaagcacctacatataaacacacaggcctaataaaaagtagcatttgagagctcacttttttcaggcactgttttaaatgctttatgtgtatcattctcacagggctttgtttactggtaaggaaactgaggcttggggaggttaagtaacttaagtccccacagtgggaagtggcagagcagggacccggaccaggcatgcaggctccagagccctcgctgttattcatcatgctgaattcacttctacaagggaacattttttctctgatgttcttttttttttttttgagacggagtctcgctctgtcgcccaggctggagtgcagtggcacaatctcggctcactgcaagctccgcctcctgggttcacgccattctcctgcctcagcctcccgagtagctgggactacaggagcccgccactacgcctggctaattttttttttttgtatttttagtagagatggtgtttcaccgcgctagccaggatggtctcgatctcctgacctcgtgatctgcccacctcggcttcccaaagtgctgggattacaggtgtgagccaccgtgcccagccttctctgatgttcttaaaacaccctgcccagtcagcctcccattttctctgctcttgacagacatgttactttcctgcttactgtgtagtaacaacagtggtccaagtgtgatggcacctcgcatttggccccaagggaagggagtcgattgggagtggtgaggactgaggcaacagggtatcagctgagttcatgccctggctgaagagggcagcttcacctggttccagccagttgtggcccagtgttgccacatagttgggttttttaaatagaagcccattctggtttttgtgagtagtctcctggtttttaaatgttggcagctaattcagaagttttaaaaagcagcacataggctaagcaatacatatgtacaggcagaggtacttgccagtcaccactctatagcctctggtctaactcactgaggctgtagcttctttgataaaatgagttgatatttcttgggtgttgaatgtaaatgaggtgctgtgtactttggaatgtatgatacagattggaaactgtcaccataattttattaatatcatagcatcagagaaggttgggactggaaaggaacttggaaatatctagtcatatgttttccaaattacaagaggtgagatgtcatgataagtgaacccttccttccctccttccttccctccctccctcccttcttccttccctccgtccctccttccctccctccctcccttcttctctccttctcttttcctccctccctccttccttccctcctttccaccctccctctttccctccctccctctgtccctccttccttccctccctccctccctccttccttccctccctccctctttccctccttccctccttccttccttccattttgagacaggttctcactctgtcacccaggctggagtgcagtggcgcaatctcaaatcactgcaacctctgcctctcaggctcaagtgatcctcctgactcagcctcccgaggagctgggactacaggtgtgccctgctgatttttatactttttgtagagatggggttttgctgtgttgtccaagctagtctcaaactcctaagttcaggtgatcctccccacctcaacctcccaaagtgctgggattacaggcatgagccaccatgccccaccagaacgttttatattttaatggttatttattttaatatgcattcagaaaatataactaatgtatgaaaactgttattttgtgaattttattgcttaaggtgagttaaagagcactagtaaatactcgcagtcatgcattgcttaacaacagggatacgttctgagaaatgagtcataggcagtttcactgttttgcgaaagaatattatgggtatacttacacaaacctagatggtatagcctactacataccatatgtatagcttgttggtatgggcatatggtatagcctattgctcctaggctataaacctgtacaccatgttactgtattgaatactgtacgctttggtaacacagtggtaagtatttgaaaaagtacagtcacaatgcagtacaaaagataaaaactgatatacctgtatggggcacttaccatggatggagcttgcaggactggaagttactccagtgagtcagtgagtgagcagtgagtgaatgtgaaggcctgggacatgaccgtatgccactgcaggctttataaacactgtacacttaggctaccctaaatttataaaaataattttcttttttttttttgagaccgagttttgctcctgtcgcctaggctggagtgcagtggcacgatcactgctcactgcaacctccacctcccaggttcaagtgattctcctgcctcagcctcccgagtagctgggattacaggtgcccgctaccacacctggctaatttttgtatttttggtagagactgggtttctgttgttgaccaggctggtctcgaactccagatctcaggtgatccacccgccttggcctcccaaagtgctgggattacaggcatgagccactgtgcccagcctataaaattaattttctggctgggcgcggtggcttatgcctgtaatcccagcattttgggaggccgaggcaggcagatcacgaggtcaagagatcgagaccatcctggccaacatagtgaaaccccttctctactaaaaatacaaaaattagctgggcatggtggtgcacacctgtagtcccagctactcaggaggctgaggcaggagaatctcttgaacccgggaggcggaggttgcagtgaaccgagattgtgccactgcactcgaccctggcaacagagcgagactctgtctcaaaatataataataataataataataataataattttctttattcaataataaattaattttagcttactgtaacatttttaccttataaacaattttttttaactttttggctcttgtaatagcacctagtttaaaacaaacacatggtacagatgcacaaaaatattttttctttatattcttattctatacttttttttctatttcttaaatttttaggtttttaaaactttaaaattatttttgttaaaaactaagccacaaaacacacagattagcctaggcctgcacagggtcaggatcattcatatcactgtcttccacctccacatcttgtcccttggaaggtcttcaggggcaataacacacatgaagttggtatctcctataataacaatactttcttccggaatgcctcctgaacctgcctgagacttttttacagctaactttttcttttttaaataagtagaaggcaatgacaataaagagtatagtataggctgagcacggtggctcacacctgtaatcccaacactttgggaggctgaggcaggcagatcacttgaggtcaggagtttgaggccagcctggccaacatggcaaaaccctgtctctactaaaaatacaaaaattagctgggtgtggtggcagacgcctataatcccagttactcaggaggctgaggcaggagaattgcttgaacctgggaggcggaggttgcagtgagccaagatcgtgtcactgcactccaacctgggcaacagagtgagactctctcaaaaaaaaaaaaaaagtataataaatacataaactagccgggcgcagtggctcatgcctgtcatcccagcactttgggaggccgaggtgggtggatcacctgaggctgggagttcaagactagcctgaccaacatggagaaaccctatctctgctaaaaatacaaaaaattagctgggcgtggtggctcatgcctgtaatcccagctgctcaggaggctgagacaggagaattgcttgaacctgggaggcggaggctgtagtgagctgggattgctccattgcactccagcctgggcaacaagagtgaaactccgtctcaaataataaataaaaaataaataaataacaaactaataacatagtggtttattaccaattattatgtactatacagaactgcatgtgctattcttttatatgactggtagcacagtaggtttgttcacaccagcatcaccacgaatataagtaataagttgtgctgtgacataatgacggctatgatgtcactagacgataggaatttttcagctccatttgtaatcttcctggaccactattgtatatgtggttcctcattgaccaaacgttgttatgtggtgcataacagtatatttaaaatacataataatatataatattatagtggtgcatgaatgtggcaaaagccatgaaggtggtttgagaatgactaaagtttgagtaacagtgatctagtctaaatcatcctttttagatgaagaagtgagtttagcaattgtgactgtttctggggttttctaatttcaagttccctttgccttctaggaaaagcttataacatcagtatttcccacacgaatttactttgccacgtagatagttccagagtgttaagtgcccagtggaaatgaaaatacttagcactgccctccgggaccttatagatcaagcatagaactcataaaaatggtggctgggttgaaaattctcattaatacacagtcaaaggattattttggttttgcttttttaaggtgatggcttttttggtcaacgtgatgttttataaatgagtaatgttaggccaggtacaatggctcacgcttgtaatcccagcactttgcgatgccaaggtggtagatcacttgaactcaggagttcaagaccagcctaggcaacatagagaaacctcatctctactaaaactacaaaaattagccgggcgtggtgaggaggcgggaggattgcttgagccaaggaggtggaggttgcagtaagctgggatggtgccattgcactccagcctgggcaagacagcaaaactctgtctcaaaaaaaaaaaaaagtaatgtttacttctaaatatctggtcaagaactgtttactttacgtaagctctttcccagagctagttttctgcggcggggggagtaagagatactgaacctcttctacttaaacagttaacattttacagaataatttcataaaagtttagtaaatccttaactatcacattggaaatctcatgccagattctgggtttacagtgtgagaaggcgaagcagcagaaggcatgtcatttaccaaggctcgttggtccccgaggctaaggcacaagagaaagctccatttgttctgccaggaactctggctggataaaatcgagctcctgcctccaagttgggggtggtggggagggccctgggccgagccactgggacttaggaaggaagagagtagtataagccagtggggttttagtgttccacaaagggaacctcaaaagcagaacagatgctgcctaagtttccagatttcaaggaagttgtcctccattgacacaatcagatttggccttggggagaacttatttgcaccctttgccttctgaaatgtaactccccataatctccttttcctctcttcctttgtttttcctgaaaatgcccacgtgtgttttgtatatttggatgtgtgtgtagggactgatgacggagcccaggaggtggtgaaggacatcttggaagatgtagtcacatctgccattaaaggtaagaaccaaggacaacccagcctttcctcttccctcattcctccaaaaagtcctcagcaaaatattttagtggtggagtttcctcttccctgccctaagaactggtggagctcatggaaactgaatcttcccacgtctgcccatcttttatatgggattcaaaaatgacttgtttttactgactgattttagtctcatttgggttgggtttaggaaacatagtctgggccaggcgcggtggctcatgcctgtaatcccagctctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactgtgttaggcttagatgctccacatagagatgccaagggccattccatatgccttgtagattaggggatgtccaggtttttctaggagtgggctggagccctgagatccatgtccattggagctgagttttcatggccagccattgatgtgtcaaggggacagtccacatgtcagcaggtatcaggtgtacagggaagctttgttttgttaggcttcattcataagtgcctcatggtatggtttcagtggaattaaacttgtatggctcagaatgactgttagatgatcttttttctttgtttctgcccaaaatctcaggtcagtgggtatatgttgaacactttgttccaatgccagtaaattatgaatttgtccagaaatcaaaatcttaatgggttttcatcagcttttttttaaatgaaagagagtaaaatgaaacagagtacaaatgatctgactgtatcacatataatgttaagtattgtttcatgaaatgtgtttcagttacttatgtgcccatgtctatactgggatacagttttataaattaatttcttacagaggtcaagatttgaaagccacttttctaagccctatctttttgtttaggtaccacaaagctatatacatattctattatttatttaacttcttatagaaatgcctgtaaaatagaaaaattttatttcatacctttagatttgtttctgggatctatacaagaagtcatcacataatggatgtttgtcttgtttactttgtgtcctccagccgctactgcagagcctggtacataattggcacttgataaatatttattgaatgaaatatgctttgtagggctattattgaaaattgttctcattgtttcatgtccctttatagaaccacattataaatttttcttagagtttcattgctctgctgatcatcagatatgctttccttcattaaatgatgaaatctgtgtaattctttattttaattcccttttttcacatggctgccaagaagctcaggtttacattttttctctgtgactaaggttttctgtcataactggctcttctctaattcctttattaatggtactttaaaaaaatctgtacctttcatgtttagctgcttctaatctttttcaaaagtgaatgggggtgggtagggctgctgcattgcacagttctggaggcaccattgatctggagagaattgtatattgctgtggccctggcagtggggctgtggataacaaacactcgtaaggcttaagcatcactttggccaaggcttttccaggattatgtcagtcatgggctggtggcacaggaaaaggggaaaaagcaacagctgggaggttcacagataacttctttttggtgtcaggcagccctttagggtaagtacagtactaatttggctatgactttgtacttgtgttttaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttaaatccatctagatttttctccatctcacgtatttttccacttaaatagaataatacagtatgtatcctgtgttgcaacctgctttttaaacaatttatattatgaacattctctcaggcccatagatatgtctgccacattatatttttaaatagccttactgttctcttaaaagttgctttaaaattaaatataaacattcaaaataggaagtaatatgatgtgagtgtccctctagaccccattttctttgtctttttaccagtgtttctcaatctttttcattattgccccttcctccaagaaaactttgtagacattttttcctaatcatcattccccattaagttgtaatgccagcaataaactggatatccatatgctacatgtatatctgtgctttatacataaaaataataagggtttgttgttcttgttgtttgtttgagacacagtctcactctcacctaggctagagtgcagtggtgtgatctcgactcactgcagccttcacttcctgggctcaaatgatcctgccacttcagccccctgagtatctgggactacaggcatgcaccaccatacctggctaattttttattattatttgtagagacatggtctcactatattgcccagggtgatcttgaactaggctcaagcaatctgcccacctcagcttcccaaagtgctgggtttacaggcttgagccactgtatccaaccagaataatgtttttttccccccttgaggatgcgcttaaatctatacaagggactcgtgttatatgctaagctgcaatttgctttgtttactcaacactatatgatgggcatcttcccctgtcagtatatgtagagctaacagaaatttttaatggccatgtaaaattctgtatggatcactgtaatctattaaccaattccctattgggtttttagattattccagttttatcataggaaatggttctataatgaatatccttatagataactcttaattctttcttaggaataaatgcctgcaagtagtattgatggttcaagagttggaagttttagctgagtgtaatagcatgcttctgtattcccagctactcaggaggctgaggctggaggatcgcttgagcccagaagtctagccaggggaacatagcgagaccccatctcataaataaataactgtagcaagatcatgtctcataagtaaatgaatgaaagagagtgggagttggaagtgttaaggcttttgacatttaacaccaagtcagtcttctgggaaggtactacttgaatacctgtccacctttaatctctcaatacccattttcccattccctcattaaaactaggcagcagcctttattcaaatctttgctagtctgataggagaaagctcctactctaatgatgagtaataaggtcatttagatttctttatcatttgcatctattggtacattgcttatccatgttgttttcattttggaggaaggttttcatatttccttaatgaattatgagaacttttatatgtgggggatattaatctttattatatgtttttaaaatttttattttatttttttgagttggagtctcgctctgttgcccaggctggagtgcagtggcgcaatcttggctcactgcaagctctgcctcccaggttcatgccattctcctgccttagcctcttgagtagctgggactacaggtgcccaccaccacgcctggctaattttttgtatttttagtagagacggggtttcaccgtgttagccaggatgatctcgatctcctgacctcgtgattcgcccgcctcagcctcccaaagtgctgggattacaggcgtgagccaccgtgcctggccaaaaaattttatttttatgttttgcttttaaatgtaatttaccttttttttaggtgaaaaaagtttatttcgtaatacctatactttgttacccgtttatcctgcaatagttgcaatagtattcttttttttactttttttttttggtcacccaggctggagtgcagtgccgcgatctcggctcactgcaacctttacctcccaggttcaagcgattctcctgtcttagcctcccaagaagctgggattagcagagatgaggtttcactatgttggccaagttggtctggaactccttacctgaactgatctgcccaccttggcctcccaaagtgttgggattacaggcgtgagccattcatcgcacctggcttacaatagtattcttagaaatatctttcttacccaagctagtataattacctgtattagttttggtttttttacagcttaacttttgatcatttttcattttaaaccacccataccaactctgaagaacaaggaacaaggttgtagaattgctgtgatggcttctccatagctcctattttgtcatatccttccctcccccacatccctcatctctctattaaatagaagaatttgaatttccaagagataattacatttctaatttttgataagagttagcttttgttttgtcctctccctttttattttttgagatacggtctcactatgttccccagattggagtgcaatggtgccatcatggcttactgcagccttgacctcctcggctcagtggatcctcctgcctcagcctctggagtagctgggactacaggtgggtgccaccacacccagctgatgtttgtttctgatcctaggaatcggatgcacaaggacatcaagtggctgccaggttctcccacgttctgcagaaggatgccttccttgtgttccgctccctgtgcaagctgtccatgaaaccccttggtgaaggccctccagacccaaagtaagcagacagcagttcttggccaccttcagtccaatgatccagcagcacatggtactgtgtttcacacttcccttgttccaagaagtttcagtgtcatgtctctttgtcagtgtaagtgcaggaacggttttacaacttttcagactcatgcagtctctagagtcctttcatatggaattgtctctgtatccccaccaaccaagattttgcccagttttgcttttcttggcatatgaatgctaaaaaagtctgtttattgaacacataaaaaacacatttttactagctagtggattgaatctcttgatgtggggtgtggagggacaggatgcctgcaaacctcagttccctgttctgttggaaacctctgcttcatcgatacagatgtaagccccagattcgacacagggaagccaaacatttctttgtagtaaacaaactactacaaggatgtcagcgctgtggagtgaagaaagcagaggcttcagagccagagagagctgcatttagatcttggatcctccacttgagagcagttccttggctatatgacttgccaagcctcatctgaaaaatgggaatatggaaaatcatcttacaggattgattaaatgaaatatcggtgttgtcctgagcatggggccttgtactttataaattatctctattgttcctgtcattagtcattaataataatcctcaattcatctattactaatgctgctaatactgtgataggtattaggaaaataggctgggtgcggtggctcacacctataatcccagcactctgggaggccaaggcgggtggatcacttgaggccaggagttcgagaccagcctggccaacaagatgaaaccccacttctactaaaaatacaaaaattagctgggtatgctagtacatgcctgtaatcccagccactcgggaagctgaggcaagagaatcgcttgaacccaggaggcagaggttgcagtgagctgagatcgtgtcactgaactctagcctgggcaacagagcaacaataaattttaaaaaataaaaataggccgggcgcggtagctcacgcctgtaatcccagcactttgggaggccgaggcgggcggatcatgaggtcaagagatcgagaccatcctggccaacatggtgaaaccccatctctactaaaaatacaaaaaattagccgggcatggtggcaggcgcctgtaatcccagctactctggaggctgaggcaggagaatcgcttgaacccaggagacggaggttgcagtgagccgagatttgtgccattgcactccagcctggacaaaaagagcaaaactccgtctcaaaaaaataaataaataaataaaataaaataaaaataagtgttaagaaaatagttcatgaaaatgtaccatttcttaccatacctgaactccggcatgggcagtggggagggagggctgtgaggtaggtggataaagagcgccatcttcatggtgtgtgaaacagagtgagccaggtgtctcagcctcccacaagtgatgtaaagtcattgattcttgcagtacagttgcagaactcgctctccagaatcagttgacactttgctcctgctgtattctctactttgtgatggaaagagacaaataggagttggcagctcttgttctcaaagggcctgcgattccagaaggacccaactcatgccatctgccctcattctcctgacatttaggtgctattaattctttaaaattctactcattggtaaaggagcaaggccttctcaagaaacatactgtttgacattttttcttttagcactgttgtggtttttcattttctttgccagatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtacggattccaaagttttttcatttcattatttactattattattagtcattaattataatactcaatattgagaatgctgctaatattacactaagcattaggaaaatggttcatgaaaatgtttcatatcttaccatcctggaactcagaagtgggcaggggcagggagggtaaatggcatattcatcggctggcaccccagtaaatcagaactttttgaatgagtaagagaatatctttttataaaaagttactgcccccagcctgggcgccatggctcacgcctgtaatcccagcactttgggaagctgaggcgggcggatcatgaggtcaggagatcgagaccatcctggctaacatggtgaaaccccgtctctactaaaaatacaaaaaattagccaggcgtggtggcaggcgcctgtagtcccagctactcgggaggctgaggcaggagaatggcatgaacccgggaggcggagcttgcagtgagccaagattgcaccactgcactccagcctgggcaacagggcgagactccatctcaaaaaaaaaaagttactgcccccggatcttatgtgcctttcattttaaccaatatggtctgtctgctgggctcagccccctaaacatatctgtttggtctgtaaattgtttgaaatcatttagattagtcgccaaattgagaaatcctattttacatgaaaatccagatttctggtttctctccaaaaagtcacagtatgggtcctgcatttccacttggcagctccccagtgggccccaccctgccagccgtccccaccaaggccagggtcccgttgctgcccagccaggtgggcactccactcttcttctgcccagggtgctttacttactgcacgactgggttggctgctgaagactttggaggttttgagccctggttgaaactgttaattagtgtcctcctttgtctttatgtcatataggtctttttcaaagagattttcctgaacattttagaaacatcaacaagttcttttgagcacaggtggatggtcattcagactctgacgaggatctgtgcaggtatttccacctggggacactcatccactggacttctgatgctttaatttgccacagctcagattaagacttctaacccctccttttagagttttaaaggattggcaataaaaggctaattctaacctagtcctgccccacctctccttttttagaggatgaccaacttaggctggtttgccaaggacttcctggttttagcactaaaagtctcatgtcccagaaaccccctaatctcgtcaaactgggacacttggttacgttacctacaagctgagtactgttaatcacaggacctaagatactggtgctgccaatttttgattgggtgctacggtaaatgtggatttaccttacactatacaattgtgtggcctcaaagtaagcatcctgcttgtctggcatcaaatgtaattttgtaagagtgacacaactttaagaggtgggtcaggcaattgttaaccccttccttgatgagaaaattgaggcttggatgggtggaatgaactgcctgagatttcaatttgctcagaagcaggcctaaaaacaacctcctgtcttccagcttcctagtacttccaacatgtgtttcctgagtgagatgtggccaccggagtctgtagttcactggggaaatttgttggcaaacatcttgtttgataagaaaacctaactgctatttgatcagaatttctgatacttgtatgttattttccaagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggtaaaaacactgtggacactcaattatattaaagtttattcattccaataaacatttattgagtgccaccacatgccaggcactgtccttgatacagcagtgaacaaaacaggaatgcatattcacacacttcctgccatcatgaaacgacattaaagaagtcagttcagatgatcataggggctgcagagaaaaataaagcagggacggcagagaggaagtgctgaaggtggggtgctgtaattcttaatggggccattagggtagtatcccttagaaggtgacctttgagctgagacccataggaagcaaattcattctcagtcacccttccaaagatagcgtggaaaacaggatcccagtctgcaataggggcaaaggagattggctagtagcagaatacctcattagagcacctacaaagaaaataggatgcttaactgtaggtttctgaatgaactggtcagagggtctccgagctccctggaattgtgtgtagaattttggtatatgggcatttttcctaaaagatggtcatagttgtcattagaatcacagagatctatgctgtccgagttgctgttttgaatctaaaatatttgcattttttttagatgatctgcaactcatattcaacttgttatttaagaatgctgtttatttttgaaaatcagtatttttatttacttaaagggtgagccttaaaattgaatgcatttgtgggtatttaggggatacgttgtatccagagtcacttacagcataattcaaggttcttttctcctttttttcagtcactggttgagaccttgttatttattatttgagtgtgaatttttttttttttttttttttttttgagacagaatctcactctgtcacccaggctggagtgcagtggcgcgatctcagctcactgcaacctccacctcccaggttcaagtgattctcctgcctcagcctcctgagtggcagggattacaggtgcctgccaccacacccggctgatttgagatggggtttcaccatattgtccaggctggtcttgaactccttacctcaggtggtccacccacctcagcctcccagagtgctgggattacaggcgtgagccacagcgcctgcccaagatcttgttatttttttaaaaatagaaaaatttaaaatttttttttaatcacataagcaatgaatgaaaacttcttttgaaaatccaaataacattgttcattttaggaaaacacatatcccatatttttgctgctggggtgtttataatgagcacctttagagatgtccagggcttttgcaatgtatccttgatacttgtcacttcttagctctgggtttgtttcattcttaatagcactgactgtcagtgatttctttcttagcctcactggggtcccagaaagcctcgtagatgtctgttctcttcatttttctgttaagtctctttcctgtgtgacttcgtcccttaggagctcagcctgaggaagaaaggcctggagtgcctcgtgtccattctcaagtgcatggtggagtggagcaaagacctgtatgtgaatcccaaccaccagaccagcctcggtgagacagcattgctgccacacccacctccattcataataggctcctacgactgctaggaacagttgtcttagtatagttgtcttagaattgaaaaagcctttttagtttgctaaatacctatattattttgaaagtcctgctttttattgcatctggagttgtgtgaagttatgctgtaacttcattgtttcaaatacagagccagttgctctagtgcctttttagtagttgttcattccctcactgattcaaagcatcacctttatgatataccacattttcctatgtacgtaagtctgtttctggagttttaatttttttaaagagacagagtctgtttccattacccggctggaatacagtggtgcaatcatagctcactgcagccttaaactcctgggctcaagcgatcctcccacctcagcctcccaaagctctgggattacagacgtgagccactgtgcctggccttctttctggattttctattctgttctgtttatttgtctgttttaacaccagtaccacacttgtttttggtatcttgtagggcaagtcctcctattcgttgttctttaagttgtcttgatctttttttgccttttttactctttcatgtgaattttagaattagctcatcaaggctgggcacggcagatcatgcctgtaaccccagcactttgggaggtcgagggtggtggatcacgaggtcaggtgttcaagaccagcctggccaacatagtgaaaccctgtctctactaaaaatacaaaaaattagccgggtgtggtggcaggcgcctgtaatcccaggtgctctggaggctgaggcaggagaacagcttgaacctgtgaggtggaggttgcactgagccgagatcgtgccactgcactccagccagggtgacagtgcgagactccatctcaaaaaaaaaaaagaattagctcatcaagtttcatgaggaaacaagtttttaagtaaagtatctgaatgatactaaggtttcatgcttataatccttatagtattgacttgttgctattacaggtttgggaaagggagccgtgcagccagacctagctcggctgtgtctgtgtcccacttgcttatttggcttcctttacttttgtttctccgcaggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgtgagtggggctgccgttaactagcagggattctagcaaagccatattttctctgggaacctggaactgattcctaaaaaggaaatgcctgtttacaaaaggctggtgctggcacttgtagctaagcctgattgagccaggcaatcagtaaatgagcgtatgtgtgtgtgtctgtgcacacagagagagaaaactttaatacctttgtgtggttgatgcagccttttttccccccttttctaatgaaaataataaaaccaatttagaaaatacagaaaagtataaagtaagaatgtaaaaatcactcataaaattactgcctgagatggcccggcgcagtggctcacgcctgtaatcccagcactttaggaggctgaggcaggtggatcatgaggtcaggagatcaagaccatcctggctaacacggtgaacccctgtctctactaaaaatacaaaaaattagccgggcgtggtggcgggtgcctgtagtcccagctactcgggaggctgaggcaggagaatggcgtgaacctgggaggcggagcttgcagtgagcagagattgcgccactgcactccagcctgggtgacagagtgagactccatctcaacaacaacaaaaaattactgcctgagggaatcaccattggtgcatttttttccaactatatattacatgaaaaatttcagcataccaaaacattactgtttgtcttatttgttttatttttttaggcattttattttattttattttattttattttattttattttattttatgttgttttcttatactttaagttctagggtacgtgtgcacaacgtgcaggtttgttacataggtatacatgtgccatgttggtttgctgcacccattaactcgtcatttacattaggtattactcctaatgctatccctccccctgcgccccaccccatagcaggcccccctgtgtgtgatattccccgccctgtgtctgagtgttctcattgtttggtacccacctatgagtgaaaacgtggtgtttggttttctgtccttgtgatagtttgctcagaatgatggtttccagcttcatccatgtccctgcaaaggacatgaactcatcctttcttatgaggcatagtattccatggtgtatatgtgccacattttcttaatccagtctacaattgatggacatttgggttgattccaagtttttgctactgtgaatagtgccgcaataaacatacgtgtgcatgtgtctttatagtagcatgatgtataatcctttgggtatatacccagtaatgggatcgctgagtcaaatgctatttctagttctagatccttaaggaatcaccacactgtcttccacaatggttggactagtttacattcccaccaacagtgtaaaagcgttcctatttctccacatcctctccagcatctgttgtttcctgactttttaatgatcgccattctaactggtgtgagatggtatcgcattgtggtttggatttgcatttctcttacgaccagtgatgatgagcattttttcatgtgtccgttggctacataaatgtcttcttttgagcagtgtctgttcatatcctttgcccactttttgatggggttgcttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttcgtttaattagatcccatttgtctattttggcttttgttgccattgcttttggtgttttagtcatgaagtccttgcccacgcctagttcctgaatggtattgcctaggttttcttctagagtttttatggttttaggtctaacatttaagtctttaatccatcttgaattaatttttgtctaaggtataaggaagggatccagtttcagctttctacatatggctagccagttttcccagcaccatttattaaataggaaatcctttccccatttcttgtttttgtcaggtttgtcaaagatcagatggttgtagatgcatggtatttctgaggactctgtgctgttccattggtctgtctctctgttttggtaccagtaccatgctgttttggttagcgttgtagtatagtttgaagtcaggtagtgtgatgcctctagatttgttctttttgcttaggattgtcttggcaatgtgcgctctttttcggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcctctgttatttcgttgaacagtggtttatagttctccttgaagaagaggtccttcacatcccttgtaagttggattcctaggtattttattctctttgtagcaattgtgaatgggagttcactcatgatttggctctcagtttgtctcttattggcataaaggaatacttgtgatttttgcacattgattttatattctgagactttgctgaagttgcttatcagcttaaggagattttgggctgagacgatggggttttctaaacatacaatcatgtcatctgcaaacagggacaatttgacttcctcttttcctgattgaatacgctttatttctttctcttgcctgattgccctggccagaactcccaacactgtgttgaatgggagtggtgagagacagcatccctatcttgtgccagttttcaaaggaaatgcttccagtttttgcccattcagtatgataattggctgtgggtttgtcataaatagctcttattattttgagatatgttccgtcagtacctagtttattgagagtttttagcatgaagggctgttgaattttgttgaaggccttttttgcatctattgagataatcatgtggtctttgtcattggttctgtttatgtgatggattacgtttattgatttgtgtatgttgaaccagccttgcttcccagggatgaagctgacttgatcgtggtggataagctttttgatgtgctgctggattcggtttgccagtattttattgaggattttcacattgatgttcatcagggatattcgtctaaaattctctttttttattgtgtctctgccaggctttggtatcaggatgatgctggcctcataaaatgagttagggaggattccctctttttctattgattggaatagtttcagaaggaatggtaccagctcctctttgtacctctgataggattcgactttgaatccatctggtcctggactttttctggttggtaggctattaattattgcctcaatttcagagcctgttattggtctattcagggattcaacttcttcctggtttagtcttgggagggtgtatgtgtcgaggaatttatccattgcttctagattttctagtttatttgcgtagaggtgtttatagtattttctgatggtaatttgtatttctgtgggatcggtggtgatatcccctttatcattttttattgtgtctgtttgattcttctctttattttcttctttattagtcttgctagcagtctatcaattttgttgatcttttttaaaaaaacagctcctggattcgttgatttttttttgaagggttttttatgtctctatctccttcagttctgctctgatcttagttatttcttgccttctgttagcttttgaatttgtttgttcttgcttctctagttcttttaattgtgatgttagtgtgtcaattttagatctttcctgctttctcttgtgggcatttagtgctataaatttccctctacacactgctttaaatgtgtcccagagactctggtacgttgtttctttgttctccttggttccaaataacatctttatttctgccttaatttcgttatgtacccagtagtcattcaggaggaggttgttcagtttccatgtagttgtgtggttttgagtgagtttcttaatcctgagttctaatttgattgcactgtggtctgagagacagtttgttgtgatttctgttcttttgcatttgctgaggagtgctttacttccaactatgtggtcaattttggaataagtgcaatgtggtgctgagaagaatgtatattctgttggtttggggtggagagttctgtagatgtctattaggtccacttggtgcagagctgagttcaagttgtggatatccttgttaaccttctgtcttgttgatctgtctaatattgacagtggggtgttaaagtctcccagtatttttgtttgggagtctaagtctctttgtaggtctctaaggacttgctttatgaatctaggtgctcccgtattgggtgcatatatatttaggatagttagctcttcttgttgaattgatccctttaccattatgtaatggccttctttgtctctttcgatctttgttggtttaaagtctgttttatcagagactaggattgcaacccatgcttttttttgctttccatttgcttggtagatcttcctccatccctatattttgagcctgtgtgtgtctctgcacgtgagatgggtctcctgaatatagcacactgaggtcttgactctttatccagtttgccagtctgtgtcttttaattggggcatttatccccattacatttcaagttaatattgttatgtgtgaatttgatcctgtcattataatgttagctggttattttgcccgttagttgatgcagtttcttcctagcatcgatggtctttacaatttggcatggttttgcagtggcttgtaccagttgttcctttctatgtttagtgcttccttcaggagctcttgtaaggcaggcctggtggtgacaaaatctctcagcatttgcttgtctgtaaaagattttatttctccttcacttatgaagtttagtttggctggatatgaaattctgggttgaaagttcttttctttaagaatgttgaatattggccctcactctcttctggcttgtagagtttctgctgagagatccgctattagtctgatgggcttcccatagtgggtaacccgacctttctctctggctgcccttaacattttttccttcatttcaaccttggtgaatctgacaattatatgtcttggggttgctcttctctaggagtatctttgtggtgttctctgtatttcctgaatttgaaagttggcctgccttgctaggttggggaagttctcctggataatatcctgcagagtgttttccaacttggttccattctccctgtcactttcaggcataccaatcaaacgtagatttggtcttttcacatagtcccatatttcttggaggctttgttcgtttctttttattcttttttctgtaaacttctcttctcactttatttcattaatttgatcttcagtcactgataccctttcttccacttgatcaaatctgctattgaagcttgtgcatgcgtcatgtagttctcatgccatggttttcagctccaccaggtcatttaaggtcttctctacactgtttattctagttagccattcgtctaatcttttttcaaggttcttagcttccttgcgatgggttcgaacatcctcctttagcttggagaagtttgttattagtgactttctgaagcctacttctgtcagcttgtcaaagtcatttccatccatctttgttctgttgctggggaggagctgcaatcctttggaggaaaagaggtgctctggtttttagaattttcagcttttctgctctggtgtctccccatctttgtggttttatctatctttggtctttgatgctggtgacctacagatggggttttggtgtggatgtcattttatttgttgatgttgctattcctttctgtttgtagctttccttctaacagtcaggtccctcagctgcaggtctgtgggagtttgctggaggtccactccagaccctgtttgcctgggtatcaccagcagaggctgcagaacagcaaatattgcagaacagcaaatattgctgcctgatccttcctctggaagcatcgtcccagaggggcacccgcctgtatgaggtgtcagtcggccctttctgggaggtgtctcccagttaggctacatgggggtcagggtcccacttgaggaggcaggctgttctcagagctcaaacaccatgctgggagaaccactgctgagagctgtcagacagggatgtttaagtctgcagaagtttctgctgccttttgttcagctatgccctgcccccagaggtagggtctatagaggcagcagcccttgcagagctgtggtgggctctgcccagttcgagcttcaccagcactttgtttacctactcaagcctcagcaatggcagacacccctccccctgccaggctgctgcctcacaggtcaatctcagactgctgagccagcagtgagcaaggctccgtgggcgtgggacctgctgagccaggcacaggatataatctcctggtgtgccatttgctaagaccattggagaagtgcagtatttgggcaggagtgtcccgattttccaggtacagtctgtcatggcttcccttggctaggaatggaaaatcctccgaccccttacgcttcccgggtaaagcgatgccccgccctgcttcagctcaccctacgtgggctgcacccactgtccaaccagtcccagtgagatgaaccaggtacctcagttggaaatgcagaaatcaccgtcttctgcgtcgatcacactgggagctgcagaccggagctgttcctatttggccatcttgggacggaatcttacttgttttatttacgtatatatttttctgaaccattttgaaagtaattggtagccatcatgagaccttaactgaatctctttgaaaaataaaggacattctcccatataaccacagcaccatcatcacaatcattggcaaatctttatgtttctttccagtcttttacacacatcaacacatacacaatcatatattccaacttgtaaatgattagttaacttagtaagttcaacttaagagttgaaattacagtactcacttattaactgacatgtttgatcttctcatttctactgccgccactccacctccctctagtgtattctgcccacagcagctaaagtaatctttttaaaacataaatcaagtcttatcactctcctgcctaaatcattccaggtttcctgttctgcaccatggcctgacccagcccctggcctcccttgctgatctcatctcctgccaattcccctgagtcacacaatgtattttcagtcccttgaacaccttcagctctttttaccatggtgccttgtgcttgaaattctcttggcttttttccatccctcagacttggtaaaacatctcttactcaaagaggccttcagcaactgcactatctaaacaggtcccaagttaagttctgcccttgcccctatttgtatctttcatgacgcttgccagtttgtgcttactcatgaatatcaccctccagctcaggcctggtaaataataagttgagtctatacattggttagctttgccttcctttagcaggaaataaaaaatgggctgggcatggtggctcatgcccgttatcccagcacgttgggaggctaaggtgggaggatcacttggagttccagaccagcctggtcaacacagtgagaccctgtctcttaaaaaaaaaaaaaagtagagaaagaaaaaaataaatacaaaataacatgcttaactatgtatttctctctcaaggaaatccaaaagtggacagtctaaggctgctacggtggcccttaaggacatcagagatccaggctccttttatctgtctgcttcaccatacttagccagagagggtggcctcatggtataagatgactgctggagtaccagccatcccacaaacattctggagaggaggagggaaagaacaaaaagagaaaaaagcagacttcccacctgagtcagctttgtttaagggtccttcctagaagtacccacaccacttctgctcatatctcactggctagaagtttatcacatggccatcctttatttaagggaggcagggaaatgttctttttattccacatggcagtgtgtccagctaacacgtagggttctattagtgttggagaaggggagagtggatatgaggtgacaatcagcagactctgaccaggtatagctgggtcagaaattgaaggtggaatttagaaaagctgccaggacagacatgaccttgctagcttatacgtgatggcatgttcatagtattctattattatttatctcaaataccagcttttgctatcctccagattttgaaataagcaacttgtgtcccatctctgcttgaaacaggttcaacaagaaacccaagagggggatccagtttctccaggagcagggcatgctgggaacgtcagttgaagacatagcccaattcctgcaccaggaggagcgcctggattccgtaaggcttgggggtgtagcacttgcatgtgagttctgtcaggtgattgtgagcccttaccagttttaacctcgagattgtctggccctaagtacattgtctgttgtccacccccgggttatacattgtctattgtccacccccgggttacagcagtcctgtgtatcccgttggctagtgttgcagaaagctctttgatgggaataaactagcctcccagcaggtggctgcatatttgctggaagagagtcagagctggaagtgttccttgactgctagaaagttcttacggctgcctgtctgcaactaacctccttagtgtgccccgtcattctctccattttaagtctcttgtgccccctcctcttccttcatccatgcaggacaggctgcttctggaatgggtgggtgggtgggcaggtcagggagttccctagcttttttaccagtccagcctattctgggcagttagggccaggctattctgactccaccctttggctgctggcttttgctgagggttcgtatttgacaatttctggatataagtgagtgtgtatgtttcagacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggtgagcgccgattttgagtcccttccagatcatctgtttgcctgcctcagaacgctaattctaatttggttggggtttaatctttgtatatctgtgccaagcaactgaagcttttgtttaccgtgtgccaggcactgtgctaagggattatttcacataagacctcacagcaacctgtttatgtccctattctacagacaaaaagattgaggaccagagaggttaacttgcccaagatcacacagctaaagcccatgctgttagcaactataaaagagtagtttcataagttgagaggagacaattgggcacctcttccctaatcaaaaacagttcccctgatttaatatatggggtagatctcaaggattttggtttttctttaattgcatactgatgagcaggttacagaaatagctacataactaataaaaaccaccaaagtacatgattttatctggggaccttttttgatgggcggttcgtgattttgtaagaagtggaaataggaaggggaacaaaccattattaaatacctcctgtgtgtgggccatgccatgggttttacatgcatttaatttaattaatggcaagcccaggaatagtatccctgttttacagatgaggaaattgagaatctgagagattgagcaacctgtccaaaattaatcagctagtaaggagcagagccagggttgaatatggatttctctaactcagaagctcatgttcgggctggatgcagtagctcttgcctgtaatcccagcactttgggaggccgggacgggcagatcacttggggtcaggagttcgagaccagcctggccaatatggtgaaatcccgtctcttccaaaaatacaaaaaaaaattagctgggtaatcccagctgctcagaggctgaggcaggagaattgcttcaacctgggaggcagaggctacagtgagccgagaccacaccactgcacaccagcctggatgacagaggcagactctgtctcaaaaaaaaaaactcatgttctctccactgaacattaaattagaaatatgtctgaatatgctgtgaccatgatgtggaaattgttcagtggaaactattttttttgagacagggtcttgctctcttgcccaggttgaagtacagtggggtgatcacagatcactgcagcctggatctcctgggctcaatcagtcctcccacctcagcctcctgaactgctgggactacaggtgcatgccactgtgcctggctaattttttgtataatatttctgcagagatagagtttcaccgtgttgcccagtctggtcttgaactcctagcctcaagggatcctcctgcctcagcctcccaaagtgggggatttacaaatgtgagctaccacacctgattgaaacattttaataactgttttgcctctcaggtcaactttgttttcatattaattgctcccagtcttccaagtgtatggcaggctgtccccaggaggtggcaggattggcaaaggcagcatatcatcattttaaccaaatggacattagaactctctatgaaggcataattagatgctgtttactttaaacgtatctcctatgtggacctgggagccttggtctgttttgctcagtcagtaaatatgtgacccagtttcatctcatattaaaagacctttgttgtgttcttcaaaatttctactgttcctgttatggacagtttggacagaacagtttctagcttcagcctcatatcgtatgaagctgtacatccacatgttgtccttctcttcttgcctaaggcaaaaaagtcagacttcaccaacatattgtttagaacaacataaatattttccatggtatttctactattaaatgttataatgggtaatatagactataaataacagctaaacagcagttttagtcatctttatatctcatgtctagcacagtacatggcacaaaatagatgttctcaggaacaggacaaggtgggggaggcactcaagcgcttagtgtgtgaaatatagtgagatgccctctctcagggtcagcaccaagtgtaaggtctcctgatgtgctcacttgcttcaccctagtcttggccccagatgcttcttagagtctttttaaaaaaaattatttgaaattgctttattcaaagaagcctcaatttttattatttatttatttatttttgagacagtctcgctctgtcacccaggctggagtgcagtgtcacaatctcagctcactgcaacctccacctcccgggttcaggcaattctcctgcctcagtctcccgaatagctgggattatgggcacccgctgccacgcccagctaatttttgtatttttagtagagattgggtttcaccatgttggccaggctggtctcgaactcctgacctcaggtgatccacccatctcggcctcccaaagtgctgggattacaggcctgagccaccacgccctgccaaagaagctaaaatttgatacagattgttaatgagctttttctacactctgggttgctaagtcttgttcagtgatgatgaaagcgtaaaaactcttgcctcatttggaatcaaggggagtagtcggctgcttttctcgtgaagtgtgtctctgttagcattgtaccttccaaaccgcatcaccatgaatattgatgtctcgaatttttttctccaggcaaactctgtttgctagtgctgacactgcttatgtcctagcgtattcaattattatgctgactacagacttgcacagtcctcaggtaaagcactttaatgatttacatgttgtattagctaaataagtggctttacttgggcaattggatgttttttaaatggtttttaattttttttaattacaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagagtaaggtctaatggcaaattatttcttttagttctaattttttagtgtatcagaatgcatgattaaatactctggtgataaatttaatgtgcatagctggatatctgaataggaaatgtgattgaattaattattgtgattatgttgggacttttataatgtcactgtcttgctagatttctgatgaggagcaagaaggaatttaaaattagtaatctgagaactaaattactcccaaaaagtgttctttaaaacttttctttaattcagattgtgtccgccttgattagaattctattagttatggcccctggggagctgtcagtttcactgtttgagaagcagcaaagggtagtggtttagagtgtggctctagagccacactgccttagatcaagtcccagctcctctacttagtaattgtatgaccctgggcaagtgacttaccccctctgcctcatttttcccatctgtaaaatggtaataataatatttgtaatggactcacgagatggttgggaggatttaggagttaatcattgtgcatcttttgaaacagtgtatggcatgtagccagccctcagtgactgctagccacacctatcatgctcttactttacagatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaagtgagtatcctgagaacttagcaagcatgtggctaagcctgattctgaagctggccagcgagaagtactctttccacgctaaaactctggatgttattgaaatcttccttccatgatagctggtgtggacgccactattggcagcctacagcatcggactccagaactgtgatgacactgaagtggcctccttgtgtttggaaggcatccgatgtgcaatccgaatcgcctgcatctttggaatgcaggtaggtgtaagtcagcaacactccagagatactggtgggttgtgctcttttagatttggcaaaacttagaaattatcagaaattttcagttaatcaagactcttagcaagctacttacttatgcctactgacaagaaatccgtagctttgtgatgacagctcgttaggggcaaaaatggagatacggattaaaactgtctttaagaatgggtaggctgggcacagtggctcacgcctgtaatcccagcactttgggaggccaaggcaggcagatcacctgaagttgggagttcgagaccagcctaaccaacatggagaaaccccatctctactaaaaatataaaattagccgggtgtggtggtacatgcctataatcccagctactcgggaggctgaggcaggagaccggcttgaacccaggaggtggaggttgcggtgagccgagatcgcgccattttactccagcctgggtgacaagaacgaaactccatctcaaagaaaataataataataataataggtagggtccaagcttcttgactggatttgacaaagcagacttcgtgttcatctgcctaacttgcctgctttggtgcttaaaaatactatttcctttttaacatcagtttttattataatttcgcatatttccaactcttccctggagaaacaagtagttcaatgcaatatgaatatgtctgtaaacctttgaaacttgaaaagttcaagcaaataaatgaaatgtaattctgaaactgttacgaaattaggaggttgacaatcccatgcatcactttgtaagtcagaagttgcaccccatttatttttaaaaactcaatcttctgttcctattcattttacagttagacattttcttttataccaagaccacaagctttgacgttagaccatctaggtttcaagaccccactctgccacctctccaaccatgtgacattggctcagctaaagtctctctgagacaccaattcatttcctcatttgtaaacttgagaaaacagacctgcctggcagaattgttgcagatgtcaatttgtgtgacagtcttagtattcaacagacatagtggaacatgggacaggtgagtttgactgaagtcaattagaaaggagagagctgcttctcaaacatgtggcagtgcatagatacctctgcaagatgttccaaaagcaagagggcattagcatggaataactgttgtgctaatgtgcagaaagccagtcaatgtgcatacaaaaagtatcagagaagcccagtgtgccagccctgcagatgtgagaatggccacactaaggttggagtcacagtgttctctcttgggtttctgttacagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgaggtacgtgtctctttgaattgccttttctcagttaggatgactcctggcttccttttattcattgttgatctcatttggtcagttctgtttttcttgaagtcaaatcactgtacctcatgtatctggaagtcaccctctctggggctgtgaaaggcgggggcgagttcaggcgcaccagctcacagtgagcacccttgcacccagcagccagtgtcccccatgaagtgtacttctgttgttgcaactttctttccatattagtgccatttttttttttttttttagtccttatgtacctcttgggagcttgggagctcctgtgatcaatgtgtaattttaagacaaagccaggagcctgattagaaatggttgatagtcacaatgagctgttagggagagtgccagtgaattcacatgtttttaaaacagtattctaagattctcacccaaggatatagttacttatgtgtacaacaatgtatttaaaaggatatttgttgcagttttagttgttctagggaaaagtttgggttaaaaagagctagatgtcccaacaatataagagattgctactttttttaaaaagtatggtacagcattttttagaatgttatgtggccatttaaaataatgttgtggaaaaaaaagacaggcagatagtatgtgctctctgatggaagtacacaatactacctaagaaatgttctagccccaactcaaatctgaattgattcaagcctatattgccagtttacaggaaatacagtggacagagaagcatgttagatatgagggtgcagcttggaaattctaggtgtgacagacctgcagagcagatgaccaggtttttcagcaaaaaaattgcaagaaaaataagggaggagggttacctatgaattaaaagagatttcagaaaagaagataaaagatgattttaaagactattgtgggaaaatggtcacagtaaaattacaagttgttataagagattgtgaggcattgtctctcgtggcaaaatacacagagaatgcagtttgaaaggatagaccaaagcattaacattctgtctgagaaatagaattatggaaactgttttattcttttttttcttaatttctaattttttctgccatctacatgtattacttttttgtttagagagaaaactgtgaaagaatagagatgaggctgtggagaatgtaaaggacagtttgacatagaaaattgctgtcatccttcttccccatgtggaccacatggctcagattcagagtaaaggctctagagcctggcaactggggtctgatttggggctccacctcttcctgcctggatggcacaggcaggttacttagtcaccgagtcccaccttcttcatctctacaatcttcacagggtggttatgaaaatgaagagggcttgggactgtatttggcaagtaataagaactcaatagtgttacctgctgtcatctccgtggcgtatggctttgctcctcttcaccagcctttcctctctctgtcacaactctgagtagtccatgttagaaataactgagttatggctgggcacagtggctcacacctgtaatcccagaacttttggaggttgaggcagaaggatggcttgaggccaggagttccagaccagcctgggcaacatagcaagaccccatatctttaaaaaaaaattatttttttaattagctaggcatggtggttcatgcctgtagtcccagctactcaggaggctgaggcagcaggattgcttgagcccaggagttcaaggctgtagtgagccttgattgcaccactgtgctgcagcctgggcaacagagcaagacctcatctctaaaataaaaaaatatatattttgaattgtgtgctttttaaaatcatttcctgccttctaaggagccataatacgtagagaatcaatgaatagttgctttttcttctaaaacatttttttagcctgggaggtattatcaatatgaggttcctgctgccagccaagtatatggcagaatctagaaatgttaaaaattaattagctacctctgcggttgtcagaagccctgagaaatcagcttggaactaataagcccttgacctttcagtattggtgacgtacttgagattccagctgtccccagcttctgcaaaagggaggacattactagcttactaataataatttaatagtgtgtgaagaaatcaggggatgattctctttggtggaattaagtctatttctcagtcaagaagaaagcaatttataagtaaagatactcggcagtgctcagtggtatagtggagtcctggactctgggactgagttgtaaggtcagcgtaaaaagcaacactgaagttcagtcagaagttcccatgaaaattccttagggtttccctggaggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcaggaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaagtatgagcaggacatggtaatgggaaggtacgatctcacaagaaagatctctttgagagggacacacatgtctgagctgggaattgaaggagtgagccatggggagacaacattccaggcataaggaacagtgagtgccaaggccctgaggtgggacaagagatgacaagttaaaggagcaacagtgaggccaatgaggctggtgtcttgtcgtctcacgaggagggtggaaaaaggaggtgggggtgactaaatgatgtgcctattaagtgacatggtgggaggaatccgccgccccagtcaaatgctttttctctctttattgagagcttactaaatttgcataaacatctatatggcataactccattgaaccaacttttttttaatgactaacttaagattacagtgccctttttctagctgtaaggtaggaactcatttcttcatgccttctttctcttagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaagacaccaggccccacagctaacagtcacggatttgcaagctaacggggatgaaacccttcttgtctcatcaggactgtcctgtaaaccgtctcttccttttgtgccatctgacagtgttcatgaatgcaagtggacgtgctgctttggcctcttaattgtgattaaactgttgagtaaaatgtctattttaccaaagtcagtagggtgcattacttttctttctatacctatcactatattggggagaaaaaccatttgctttaaaatgttcagatctctagtgcctgacattagaggggtgtgtatttgtgtctctaggttttaaagggtaggttcaacatttcttccatctttattggggggcttttattaaacagtattcttatgcaagtagaattatttctctggctatacattggattgagaaactcttctgattgatgtaacatggtaataatagtaaatagggcaaacagatgtgccaagtcatattctgagcactcagtttatatattttaactcatttaatgctcaaaacaatccaatgagaacagggactgttatattccccattttgcaattgagaaaactgaggcacggagtgaaaagatatgagcagcatcatactgcaaaggagtggcagaggtaggattcaagccctaagccatccaactacggagtgtaggcttctaggtcccatttagtgagtggaatagtacagtgtcatggttaaaagtatggactctggaaaaatggggaattgtaatagcacccacttcttagggttctcgtgaggatgagtgtaatgaaagtctgtgaagcacaccaagcattcagcaggtgtgagccattaatgttctaggagctctggattaatatcaattgattcaaatttgttttcctaaatataggcctttaatactataaaaatgtaaaagattatagagaaaggtagatggttggtagaaacaagaaagcttatactaaggatatattttaaatgcccaatgccaaaacaaaactttaattttatcatcagtgggtttttgtttcttttttgaacttgcagagtcattcccatttatgtcccctgtccctgcgtgttgacataacaggatgctttgttctaaatacttgactgtttttgaagtactgctgattttgtgcattgtgtttcaggtaatttggtgagtggcggagtggataaaagacagatggccagcttccaagaatcggttggtgagaccagctcgcagagtgtggttgtagctgtggacaggtaatgattttattcttcagtgaccctgaactacacagtggtttggtggcctctctgtagttactggacatgaatgattcctaatttctttaactgatacaagtgttgttagctacaaattgcttaagtgtcacatttatttgcattttgaccttttagaaaaggtataactttaacattgtgacaaattatgtcaaaaataagagtttttcgcttatgttgatgttttaaattaccttgtttccttagtagaaattatttttttaaaaatcacaagaagagtttaggattaaaagcctacccatgctcacgcctgtaatcccagcactttgggaggtcaaggcaggcagatcactagatcaggaaatcgagaccattttggctaacacagtgaaaccccgttctactaaaaaatacaaaaaattagtcaggcgtggtggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccagtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctacccatgaatgagagttggctgagttgacagtttccttttttttttttctcccctcaaaacttttccattatttctctttactcaaaacttgacctaaaaatccaggagagatatttcccataaagaagcttcgtacttattagcaatcactctccgttttcttttctttccttcccccattccttagtcactgtaaccactgatctacagatttgcctgttctggacattgttccattgtccatctttccctttttattattttaatattcattatattctatttattaaccacgtagtttccttatactaacatctttccctttaattctatcctttttcaactcatgtatgttgcctctattgttaagtgcatataatgtcgtgtcttttgtgttcccatcttcttccactgttactgccttctgccttctttgtgttaaatagatattttctagtatatcattttacttctggtcatttcttgtactatatcttatgtattgattgattgattgattgattgattgagacagtctcgctctatcacccagtctggagtgcagtgatgtgatcttggctcactgcaacctctgcctcccaggttcaagtgattctgctgcctcagccgcccaagtagctgggactacaggcatgcaccaccatgcctggctaatttttgtatttttagtagagacagggtttcaccgtattggacaggctggtctcgaactcttgacctcaagtgatccacctgccttggcctctcaaagtgctgggattgcaggcatgagccactgcgcctgggctcccccgtcttttgatgtgtcactttctcttctgctcactataggtttttctgctttcaactcagttcactttccttgaaccgttctatacttgtaataccacatcatttatttcggtggaggtgtcagacctgatgtttcctctctaccttgtctgagagtttgagaaacttcagcttccaaatctaattaaaaagaaaaaacctgtgtgaccagagatcatctggcttttatgcccagtactaagacagaagcagaattgccctcagtctaccaaatctaatgtttattttttgtttttttgagacagagtctgtctgtgttgcccaggctggagtgcagtggcgcaatctcggcttactgcaacttctgcctcccgagttcaagcgaatcttctgcttcagcctcccaagtagctgggattacaggtgcccgccaccacgcccagctaattttttgtattttttattagagacaaggtttcaccatgttggccaggctggttttgaactcctgacctcaagtgatacaccctcctcggcctcccaaagtgctgagattacaggtgtgagccaccacacccggtctaatgtttattttgtctggaattatcttcctaggatttttactgggtctaccagactggatggaaatgcaataggtatgtatttgacttacctgtgaaaactgcagaagcctcacgctgtgaccgtctgactgttcctaacgaggctttgcttgtgttgttgggtctggcctgtagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggtaactcttcaaatttaaaaaccattcctgttaaaaaaaaaaaaaagtagacaactgaattcaaaaaaagaagtgataaataatttgccctgttttttagatgcctctaattcattttccctgtgcagtcaaggacagcttgataggagtaatatcatacttatatattggtagcattcatgtagaatgaattaaaaatccagtggtattgaaaatactttaatatcccacatgcaggatgtaggctaagaccacaaagattattacagccactagacaaatacactgatgcttggaagcattgtgaaatgaaatccagaaaggccttttaaatgacctaatgttaagttacgttccaggtagttttactcttcaatgtcactgcttcttgtattccggcacctattgccaccattcttctgaaacttttattgaaaaaattaatatttgggccgggcgtagtggctcacgcctgtaatcccagcacttcgagaggccaagatgggcagatcacaaggtcaggagtttgagaccagcctggccaacatagtgaaaccccgtcaccattaaaaatgcaaaaaaattagctgggcgtggtggtgtgcacctgtaatcccagctactagggagattgaggcaggagaattgcttgaacctgggaggtggaggttgcagtgagtcgagatcgcaccactgcaccccagcctgggtaacggagcaagacttcgtctcagaaaaaaaaattaataattgtttttaaatcagtaacaagccaaagacccatctgggttctaaaactgacaactgttgggaataaaccagactgaacttcttcctcgttaccagaagttttattatatacatacagacatatgcacacatgttgaataaataaaatgtcagatatgtgttttatcacggccaaaaaactgggaacaaagcaatcaaaagaaatgtatgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccggcgtggtggcgagcgcctgtagtcccagctactcaggaggctgaggcagaagaatggcgtgaacccgggaggcagagcttgcagtgagctgagatcgtgccactgccctccagcctgggcgacagagcgagactccgtcttaaaaaaaaaaaaaaaaaaaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaatgcttaaaaatagtgttagtaaaaaaacaatccagaaattctgtacattgaatagaggaaaatcttaaaaagtagtctaccattggggtatagaataatcaatggggtgctggtaaatgatttgtagcatctgccagtttctgtgtgtaaacaccctgccacagccaatttaaagttagcaatatgatgtaactagggaagagatgggcacctcattacctcttgtggacaggtgctagtctactccaccactcccctgaaatgaagcattgtcatatgtaggcttgcttctaacttggtgcatcagctaatgaaagttccttgtttttccatcagctcaaattaaggcacctcacagcacactgtctgttttacaaaataatctgagtgcttcatgctgggcagtggacagatgagacccctgcctgcatggagctccctgtcattttatgataagataactgatgggaaaggatcaagcatgtcatatatcagggttattgagaaaacatggtcagggaaggtccctctttggaggtggccttgagaggcacaggagcctgtggatgatccaggggaactatttgttgagtggatggtatcactttaaataatcaactaactcagcaccatcttacccactattctgagtaaacaaattcctaattggaccaattgaaataattgatgtgaatttgcttgagaaagaaaatgtgaatcattgcgactactgtaccttgtattcttgtccaaacatgtgacagctaagccagaacaaacgctgctcatttattccacaagatcatttggctagcaactgtggaatcctttgttctctcagaaatgactagctaaaagtgttttggtaaacgttttcccaactctttaaagtctgcattttgtgttcattgggacttctgttttgggaggggaacatcagtttgctcaagttactcttcccacctgtgattctgttgtgaagaatctgtgtgtgccaattctcagtatgtatggaccacttacaggcaaggttgggacatagggtggcaggtgggaaccagacatttaattgtcatcaacttcattacaaatgtctgtttatttaatcagtgctgtttaagcaccaggtcatggaaaactcaggaactctttttttttttttttttttttttttgagacagagtttcgcactgttgccaggctggacggcagtagcttgatctcctctcattgcaacctctgccttccaggttcaagctattctcctgggactacacacatgcatcaccacacctagctaatttttgtattttcagtaaagacagggtttcaccatgttggccaggctggtctggaactcctgacctcgggtgatctgctcgcctcagcctccgaaagtgttgcgattacaggcatgaaccaccgtgcccggccctcactctgggactcttaactttttccaccaccttggaaagatgttcttcccattgtgaactggggcacttaagaatcttgcagatttgaagaaatagatatggctcaatccagctgtaacttagccctcaggttgctggcagagttgttcgcacagtcacatgattctcttgaactaggggcaccagccctgtgtcctggatgagcaaagcttcacactaagcatggtgtgtatgcctggagcatctgttttacctggatatttaagaaaggaatattctttttgttagtctctaattacattaacatactcccctttacacaaaaattacagctaaaacatctttggccaccctcccccacacatctggccctccccaaagctaattattcttactagtttgttgtatatctttccagacatttttgtattcatgtgcatatgtatgtactcatagaaatattacagataatattgtcttggtttgtttcgctttttaaaaaaattatacatagcattttgtaacttgtttcttccacttagcaaggaatcataaagatttaaccatgttagcatatgtagatttgttctcttttaagaaattgtaataaaatacacataacaggccgggcacagtagctcactcctgaatcccagcagtttgggaagctgaggcaggcagatcatctgaggtcaggagttcgagactaacctggccaacaaatacaaaattagccaaatacaaaaattagcagggcgcggtagtggacgcctgtaatcccagctacacgggaggctgaggcaggagactatctcgaacccggggggtggaggttgcagtgagcagagatcgtgccattgcacaccagtctgggtgacgagcaaagctctgtctcaaaaataaaataaataaaataagattaaaaaaatagaataaccatcttaacaattttaagtgtgcggttcagtagtgttaggtacactcacattgttgggcaacagatctcaaggacccttttcatcttgcaaaactaaaactgcatacccattaaacagtaactcccactttcaccctcctgaccacaggcaaccaccattctactctgtgcccctaggaacttgactactatgggtacctcatataagtagaatcatgctgtgtttgtccttttgtgactgccttatttcattcagcatagtaatgtcttcaaggttcatctgtgttgtagcgtgtatcagaatttccatccttttcaaggctgactttattatttatttatttatttttgagatagcattttgctcttattgcccaggctggagtgaagtggcaaaatgtcggctcactgcaacctctgcctgccaggttcaagcaattctcttgcctcagcctcccaagtacaagcaattctcctgcctcagccctcccaagtagctgggattataggcacccaccaccatgcctggctaattttttgtatttttagtagagacacagtttcaccacattggccaggctggtcttgaataccagacctcagatgatccacccgcctcagcctcccaaagtgctgggattacaggcgtgagccaccacgcttggcccaatttttatttttttaactttttttttttttttttttttagagacggatcttgctctgtcacccaggctggagtgcagtggcaccattttggctcactacaacctctacctcccaggttcaggcaattctcctgcctcagcctccccagtagctgggactacaggcatatgcaaccacgcacagctaatttttgtatttttagtagagacagggtttcaccatgttggccaggttggtcttgaactcctggcctcaggtgatcctcccgcctgagcctcccaaagtgctgggattacaagtgtgagccaccacacccagccccaatttttcattattacaaatgatattgctgcattctattaaaaataaaacattggccgggcacggtggctcatgcctgtaatcccagcactttgggaggctgaggcggttggatcacctgaagtcaggagtttgagaccagcctggccaacgtggtgaaaccccgtctctactaaaaatacaaaaattagccgatcttggtggcgggcacctgtaatcctagctactcaggaggttgaggcaggagaattgcttgaactggggaggtggagattgcagtgagctgagaccacaccattgcactccagcctgagcaacagagcaagactccgtctcaaaaaataaaataaaataaaataaaataaaacatcaggtcagaccacatatcaatgaaatggctcacttggagcaggcctctgcaagatatccccagatctcctggcagggggtgtgggtgggaaacattctcttgctgtttttagagattctccttgagagaaaagtctgaaaagcaccagccaaatatttacccataactccagttcctaaaagtaggcaaaccatagacaagtacaatttttaaggaaattgaaaagcctcaataattttgcagaagttttggagattgatgatatttattttatagtcatttgctttagatgacagacattgggaaagtgtgaaaaggctttccatagactgtaaaggcttttgacccttcatatatatatatttggagaaaattaaatagcaccttgggagatgttgtttaatggatatagagtttcattttttcaagatgaaaagagttctctgccgggcgtggtggcttactcctgtaatcgcagcattttgattgaggcggcctgatcacttgagttcaggagttcgagaccagcctggccaacatggtgaaaccctgtctcttctaaaaatacaaaaaaaagtagctggacggggtggcaggcgcctgtaatcccagctactcgggaggctgaggcaggagaatcgcttaaacccaggaggtggaggttgccagcctgggcaacagagttagactttatcttaaaagaaacaagaaaagaaaagagttctgattggcttcacaatagtatgaatgtatactactgaactgttcacttaaaatggttaagatggtagattttatgttatgtatattttacaattagaaaaattgggtatagttgcaagtttaatagcaaaagaaaaaaaaaagaaaagaaaaaaataggttgggcgcggtggctcaccctgtaattccagcactttgggaggccaaggcaggtggatcacctgaggtcaggagttcgagaccagcttggccaacatggtgaaaccccatctctactaaaaatacaaaaatcagccggcaggcacctgtaatcccagctacttgggaggttgaggcaggagaattgcttgaaccggggagatggaggttgcagtgagccgagatcacaccactgcactccagtctgggcgacagagccagactccatcttagaaaataataataataataataaaatgaaatttaaaaaagcagaaagtagcacattttaaatgcatatttaattaactatgcaatactgatttcgtcattacacttaaaataaaactggacagatcatagccaagaaatagcattttcttttctccttaggtgtgttttccctgaatgtttgttttgaaggtaggctgtccatctttgctgttgagagacccacgtcggtcattattacactatacctgtttcacatcagttcctgttcttgttcaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtatgtgttttgctctggaagacgcttggtcaaattccccgttggggctcccagaagccctcctaacactaaccacatgattaatttttttcctcccttgtcagtggaaacaaatagaatgaatagactgtgattcacatcgattttccttaaacaaatctcactaaaatctatgtgtagcctttcctaggaggacagatgtcaccctgcaacttgtagaaatatgtcgtgaaccggctgggcacagtggctcacacctgtaatcccaacactttaggaggccgaggcgggtggatcacgaggtcaggagatcgagaccatcctggctaacacggtgaaaccccgtctttactaaaaatacaaaaaattagccgggcatggtggcgggcgcctataggtccagctacttgggaggctgaggcaggagaatggcgtgaactcaggaggcagagcttgcagtgagccaagattgcgccactgcactccagcctgggtgaaagagcaagactccgtctcaaaaaaaaaaaaaaaaaaaaagaaaagaaatatgtcatgaaccccttttggggctggttctcagggagattaaaggaagagccactgcagaagcatcctcaaaccaggataagaattatgtgacccatcacttctcccccagggaggtcataaaagaggtcaggataccgggccctgtgaagcagccgtactgttcatttattcactcggcctggacttattgagacttgccatctgctaggtactataaagaagacattttaaaatcctgtgtttggccgggcgcggtggctcatgcctgtaatcccaacactttgggaggccgagtcaggtggatcacctgagcaggagttcaagaccagcctggccaacatggtgaaaccccgtctctactaaaactacaaaagttagccgggcgtggtggtgggcgcctgtaatcccagctactcaggagactgaggcaggagaatcgcttgaacccgggaggtggaggttatagtgagccaagatcacaccattgcactccagcctgggcaacaagagcgaaatgctgtctcaaaaaaaataaataaaaatgaaataaaataaaatccctgttttcattcagccttaaatagttgcacctgggtgtgatgggcatacaggagttcattatatattactctacttttctctgtgttttaaactttccataataaaatttaaaaacaaatctctgtttaattccaatagaaaaacaaataaatatcagtggtggtaatgggctctgaaggacattatatatatcaaggtaaggggatagggatggaagcactcttttatccagggcagccagctaacatgtgtttggtaagggcacccttaggaaaaggcctgaaggaagtcaggaataatctgagagtggccatatgctgccttggcatgagaattatgaacagggaagagcaaaagcaaaaggcccgtagcaggtagtgcttggcataggtggggaggccagtgtggcttgaatggagggaacaaggcaggtagtagaaggtgaagtccctcccagtggtggcagggtgcctagctcacataggagctgtcggccattgtcagcactttggtttgctctctgtgaaagatggaagccgttggaggtttttgtttttttttttgacggagtctctcctgacctcatgatccgcccacctgggcctcccaaagtgctgggattacaggcacgagctaccgtggccggcctgccattggaggattttaagcagagaagtgaaatgatctgacattttaaaggatcaccctgcatttatccatggaaaatgaggaccattaggatgaggtaggaggccattgtagttgtccaggtttggaccaaggtgggagcagtggcagtgatggattagattctgtgcacatttggaaagggaatcttacaccatgtgctgatgaattggccatggagcataaaggaagagatgtcaaggatgacttttggacctaattcctcttgtctgctattcccctaaaaagtgtacttcagatcagcctggatcttttttttttttttttgagacggagttttgctctttttgccgaggctggagtgtaatggtatgatctcagcttactgcaacctttgcctctttggttcaaacaattctcctgcctcagcctcccaagtagctgggattacaggcatgcaccaccatgcccagctaattttgtatttttggtagagatggggtttcaccatgctggtcaggctggtctcaaacccctgacctcaagtgatccacctgccttggcctcccaaagtgctgggattacaggcgtgagccgccacacctggtgttgcttttttttttttttttttttttttaagaaaatgggagctcccaagctggatgccagagcaggctgttagggtagtgaataaaagggtaccagaaaagtttccttgacatgtctctctttctcctagtgtctgtatgtctgctttattgctcattttaagagaaccaaaattaaacccagagtctggcatcaccctttactttagcaaatacacaaaagtattttcctacctttaggaacaccattgagagtgcctgaggagactgagtcctcacatggccaagccacgtgtgcaagcctaattgcacggaagccctcaactcctaactccaggccttccctgcctatcctattcccatttgaaaaggggcagagtgagtttagaatcacatgttgccaggcactctcagatactgttggtggaactgtaacttaactgtaacatttctaaaagcattttggtgataagtgtcaagaatcctgatatttttatgcccctttgactcagtaattccacacttctgtaattctccaaagcagttaatgtgaaatatagtaaagcgttatatgtcacagaaaatagttttctagaaaaaaacaaactatctaaataaacaagtgttaaagtaaatgttggtaccggtacaacatgggatattgttttgctgttaaaaatgttcacaatgtttggccgggtgtggtggctcacacctgtaatcccagcactttgggaggtcgaggcaggcggatcacctgaagtcaggaattcgagaccagcctggccaacatgctgaaaccccgtctctactaaaaatacaaaaattagccgggtgtggtggtgtatgcctgtagtcccagctactcaggaggctgaggtaggagaatcacttgaacctgggaggtggaggttgcagtgagccaagatcgcaccactgcactccagcctgaatgacgagagaaactccatctcaaaaaaaaaaaagttcacaatgtttataatgtgggaaatgactaatactttagagaaatggacaggttatagaattggacagacaatataatagagatagtgaaacgtgtatctctccatatgaaataccatatatcatgtaaaggtttttttttttttttttttttgagatgtcttgccctgtcgcccaggctggagtacagtggtgcaatctcggctcactacaatctctgcctcccaggttcaaactattttcctccctcagcctcccaagtacctggaatcacaggcgtgcatcactatgtccagctaatttttgtatttttagtagagacggggtttcaccgtgttggccaggctggtcttgaactcctgacctcaagtgatccacctgcttcggcctcccgaagtgctgggattacaggtgtgaaccaccatgcacaggtaaatttttttttatcatactttttctgtattttccaaaacttttactatcatcatatctttcttttaacaatcaggcaaaaaaacattataataaatatagttttgtcaacaagttgctttattctccatggggagacaaccatgaattcatttttattatatattggaagttacttatgttgtgtagtcagtcctttgttatctgcaggtgacatgtttactttgtgaactttcagctaatttttaactgttttgactttctccttgccttctctaaatggcctttcctgttattggttagtgtgagcctggaagacaaacatgaatgtcattctaagccagataaaatttgaaagtcatgagcctgggaggcagaggttgcaatgagtcgaggtcgctctactgcattccagcctgggcaacagagcaagaccttgtttcaaaaaaaaaaaaaaaattgaaagtcaaacctgtagtcccaaggccactgtactgacttttaaagatagtactatcgaagcagtaggcttatatagctttccttcttgctatttgtgagataataaggttcctccataattgtatgtcttaacaggttgagagacaattgcagctgttccagaaaatcagccattttctctgtcttcaggttttactttataataatttaggtaaacattgcaccttaaactatatatgtatactccaatccacatatatgtgtttatcacataggtatatccctacccaaaaatcttaagaagatacacacaagaatttagtaatgattatctctaggtggcagaattatattatttgaaatgtttttggccagaaaaactgaccagcagtgacttaaaccacaaggctatttattgttttcgtaacaagaaagaagtcagaggcaagcattcaactttggttccatggcctggatagggaccatttatttgagacccaggctttttccttttgttcttccattcagagggtcagcttctcaaccttgagtttattgtttcgtgattgcaggatggtggttgtagctctatgcagcatgctaggtttggaatggaagtgagaggaaacggggcagagcccaaatgtggattgctgtgtgctataagaaatgtttaagtgctgcttctaagggatgagctatgttcatttctcttcccattctccaaagtacagacgatatggccgtcccattctttcctcaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatggcctttcctgttatcagtcagttggggtccagcagataaacgtgaatgttatttcaagccagatgaaatttgaaagtcaaatcaatcccaaggccactctaatgactatgaaagaattacagtcaatcctcattattggtggattccgtgtgtatactcactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctgtcatgacataaacaagtgtgcttaatgtggcctatcgagtgccatgtttttttacattttcgtgctttttgttggtgatttcactgtttaaaatgcccccccaagcatagtgctgaatgctgggtagtattctacgtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttccctaagagccatggttcagtattcttgaattcagtgtttatggcaactttatagaatgtaactatcaggaataatgagaacagactatctcattatttcccccatgttactaaagaggaaattgaggcacagaaaaataaatacaacaacttgcctgaggacacacagtttcgatgtagtggaaccaggacttgcactcgggcagtcgagcccagagttagtttagtgtccccctcctctggactgaccaggagtcctgggttctgcctgcgagcacgtaacaagatgtttacttcatctctatggaaatttttaggcatcgagttatctttgcacatagttggcgttcaataaatgaatgaattgatatttgggcctttacatcattgcttgagcgcaggaagactgtctagcccaagctgtacccagtgcattcattcctgagtaatttaataagaaaaactgtcttccaaagatactgacatgcttttcttagattttcacagttaattatctctgatgtatgtgtgtgtgtgtgtgtgtgcacgcacgtgcattttttcatccccatttctaaatcctggtcttatgaaaaatgtgccttgtgttcccccagcaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggttcgtttttccccaccttactcagatgggcagtgaagggaaaaggtcatggagcagaaattcttgctcctaacaaagagctttccagctactcttttagaaatgtgtgtttgccctaaattaggtgtttatttcaaaatgctgccatgacagggagttaggccttttcattatttggtatatgtgaaattctgtattttattcatactgaatctatggtattctacaaattgtttttgtagaagttagttgtattttagcttttgtattttggcaaagctcaagaagctagacgtttctatttgaaagaaaacaaacctcccttgtaggaaatggcattatgtctttgtaatgtgcctgagaaatcatatttaaaaatcaccttttgttttctcctgaaaatgatggggtttttgtttgtttgtttgtttttttgatgtgtctcatctttctaaagaggcctatttggtttaaatgacagagtcccaaaacactgaaatagggtgaaaacaagtccatctaaactatgatgtcctgtgtagatctctacttaagtttcctttacagaaagagctataaacctgtaaggtgatatgtctcatctcttacaacagctcactaagatgtgatgataatgggagccaatgttgattgagcacttagtacttgttgggcaccattctaggtattttctgtatgttgattcatttagtccccatgtcagacctatgagatgtaattatatcccattgtacaggagagttactgaagcacagagagaaattgcctaacattacataaccagagttgctaaagaaatttcagtaccacttcaagagtggttacagagcagaggggtcaaaatcccagaaatagggcagagagtagggctatacatgcagactgtagaaagactgccaggtcctagctgtatgaccttgagcagcttactgaagctcttgatgcctcagttaattcatctataacctaggaccattgtttctacctgccacttggaatccttgtgagaattgttaatccatgaaaagaactttaacagtgcctggcccatagcaagcactcagtcaatagtagctgctggtattattttaagtaatgtgtatgacagtaacattccagaaagacctaagataatgatacatcctggatattttgtcaatactatttgacctttaagctcttcttagtataacacctcccacccccaggactcttgtgatctgccccccttcaacttgttctaaaacccgcagaggtccataggtttgtactgggaaactgctcatatgccctttgggacagataatgtctttgtgtagtctgttcccactgtacccttgctgaatggagatttttgggagagaaaaatgtgtggggccttaatctgcatatagttccctttcagttccttccttttgcatgcttagtttacacctgagatgtgatttttcatcctaggtgctacaagaatacacaagtgatgacatgaatgtagctcctggtgacagagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgttgttctcttctccaccattctctcttctgtgcctgactttgtttcctccaggggactcacagtcatgtttgagatcatgaagagctatggccacacctttgaaaagcactggtggcaggacctgttcagaatcgtgtttcggatttttgacaatatgaaactccctgagcaactgtcagaggtaggtgataactacagcactgccctaggtatgatggagaggaaagcctttctggccggtatttgcctctgggggctgcatcatcgtctacccagagttcttaaatactgagcaacttaaggttttaaaaatggaaacacctttctgatactctcctaccagtatcagctagtcctgagtgactctccccatgttcagaagaatgagaggaaatacatctctgtggtctgctgcttggccctcaggcattgcaccttccagttcagcagggctcctgactggtcgttgtagttgttttgttcatatcaacctctgagcagtcagaaagtggaatgtctctggccccttaagggtttttaatgaagttgcatttggagatgatgttgaatattaagccttttttttaaaaggaagtttgatgcctgtaggtatttttatttgtcccttagaggtacagggatagtgaaagggtattctaggctcaggatttttagatggaaaagtaacctttttatttcttttgggaacaccattccttctctcaccgcaacataaaagtgacatatgcttaatatggaatattaggcaaacacaaaaaaattcttccttttaccatccaaaattagagttaatgtttttgcaaaattttctccatcttctacatggtttaaatatgattcggaggccaggcacaatggctcatgcctataatcccagcattttgggaaggtgaggtgggaggattacttgaggccaagagtttgggaccagcctaggcaacatagtgagaccatatctcttaaataaataaataaatatggttgaggtcatagtatagatagagttttctaatctttttaaatttaaatatgtttttcctcattataaaacaagtagaactacagaacacagacaaaaacaaagaagaatttaaacactcacagttgcggtttttcataggcagccaccgttaagaccttcaagtgttgctttcatctgtgtgtccacccacacatgcatttgtgatccacttttttcttctatgaaaatagaattccaacacacgtatataaactacttcttaaacttaatacatgagtattttttcgtagccataacttttcttctagaatgttttgtttgtttgttcctttgctttgtttcgtttttttgagacagagtcttgctctgttgcccaggctggagtgcagtggtgtgatctcggctcacagcaacctctgtctcctgggttaagcaattctcctgcctcagcctcccaagtagctgggactgcaggctaatgccaccatgtccaggtaatttttgtaatttaaatagagacaagatctcaccatgttggccaggctggtctcaaactcctgacctcaagtgatccacccgcctcagcctccaaagtgcagggattacaggtgtgagccaccacacccagcctttcttctacaatgttgttttaataatggctacaaaatagtcttagttgtggatgttccacagcttatgaacatttaggttgctttccggtttttctggacagcactgaaatgaacattttttgcagctacacttctagtggtggtgttttcttctttaaagacaagtggcccaactgccaggtttggggcctgcgtattactaagccttttgatacgtaccactaagctgacctgcagatatctctgtagccatttacacttctgtcagcaatgcatgagagttcctatttctccatattcattccaggtcttctcattttaatttgttttagtcattgctaatttgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagcttttaagtaaccaaatctatgcgttttttatttatttttttattccacttctggcttccacttttggcatcattaccataattttataaagatccctctgtatatcctctgtacatatgaatgtattaacatttttaagacgtattcttgatacatatcaccaaattgctttctacaacagttttgccaggagtgtacaagaatgcccatctcactgcagggagaatagcttttaagtgtcatctttttgttttcccagaaatctgagtggatgacaacaacctgcaatcacgcactttatgctatttgtgatgtttttacccagttttatgaagctttgaatgaagttcttctttctgatgtatttgcacaattgcagtggtgtgtcaaacaaggtactctttaagcctctaggcatcatttttcttacatagtctttaatgagaggttagttttttcaatatttaaaagcatggatgtagtgccatggagtacaatatataatttagttggtgaaatgtatacgttttaattacagtataaaaaacagtgccccccccaagtcagttcataaagcatttcttaaagatgggatatagttatttttgtattctacaagatgtaccttcatgtattatactgttctttttacttttgtatatgtttgaaattttctctagtaaaatgtttttaaaatgtattgtttcagtcaagatcaacagcttcatcaacagacaattattttagagtttgtcaggaaaaatacccagctagcacattagaactggattccatagataattttggcttagggcaagaaatttagttacatttttgaaaaagtgacttaattttaaaataaatgacaaaacatttgatattgttcaggtggcaaaaattggaaatgtaatgtatgagtgactaaatttttgaaaacctggtctaatgttttctctcttctattaccatttttcatacatgagccacttaatttaaagtagcaaaatgttgacctttcttctttagcaataaaactatgataaacaattttaactcttcaaaaaaattttaataaaaattttaatactgtctgtagcatggcttcattaattaaaagcctagaaactcaccagttgctgtctccaactcacaatatacagtatttgagacctggttggcatcaaaatagcagtagaagtttaatgatagatactgctttattttacagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgtgtaagtgttcatgcagttgttcccgtttatctctgtgttcagtggatgtcttaaagctcctgattgcctttcacattgattattttttttctctatttttttcttcagtttgctgacatggagacctgtaggaatggaggaagattcatcagaaaagcatttggtaggatttggggtttttctttggttgtcttttcttttttctatcttagtaaaagatcaataagcctgtatagtttgtactttttttaatgggaagtgagtaaaattataagatctaaaaatagtatatattcataatatattttttagaaagtccagaaaagcattaagcaaataagtaacctcaccaagtaaaaagcacagtttacatttctagctgccgctttgtgtgaccgtgcatgcctaggaaaaccagccatatttgaaatgagggatcagttagcatataacaacatctgagcatttttccatattttaaacggttctttgagagcagtcttttcagtggctgcatagtattataatttctttacttctcccttatcggactctcaggttagttctaggctttcaacattgtaaatagtgctttggcgtaactgtgcttgtttgttgccctcctaaattaatagtgctttcctcttcaccaaagaagtggtagttcttactttttgtgtgagtccacataaagaagttttaattcagatctcacttttaaatactttggtttacagagaggagttgaattaacttttattcctaagtgactctaagaccattagattttaaaaagcatttgggatacagcaactgtcttctgctgttaaatttttttattttttattttattttatttttctcgagacagagtctcgctctgtccccaggctggagtgcagcagtgcgatctcggctcactgcaacctccacctcctgggttcaagcgattctcatgcctcagcctcccgccaagtagctgggattacaggtgcccgccaccatgtccagctaatttttgtatttttagcagagatggggtttcgccatgttgaccaggctggtcttgaactcctgacctcaggtgatccgccttccttggcctcccaaagtgctgggattacaggcatgagccactgtgcctggcctgttgtcaactttttaaaaaactagttactgcactagtaatttatctttgaacttgctcgcataaaaaatttgtcacacttattgttaaatcctaatatgtagagaaatgtcctctgggttggaataggaaaatagggaattttaatgggaggagaagtaatttaaattcttaatctctccattgcagcctgtgaggcatgctacattaagcatgtagtatcattttattttgagctaagcaaggcacttaaatacaggctggaccagccgtgttaaaacaggcacatctctgcccaaattatcatgaagaaaagtgagcattgtgtttccctctggtttacatttaggatgtggatctggaccgccagtctttaagcagcatagataaaaatccctctgagaggggacagagccagctctctaacccaacagatgacagctggaagggtagaccatacgcaagtaaggccactttttaatttgttttaaataagtaacatgtttatgtgattcatatattcagaaggcacaaaagggtaaacatgataagccttcttctgccctgtgcctcagtctgccagttctctgtagcagccaaggttacctgtttctctgtacctttccagagtcattttatccatgtgcaggcaagtacatgcacatatacattcatatacatacatatatagtacatacgaattttctccttttaccagttatggaatagtacattccatatacattgacatatacattcacacacatacatatatagtacatatgaattttctccttttaccagttatggaatagtatgccttattcttttttcagttaatatattttagagatcattcaaaatcagtacataaggagctttcacgttgttttatacgattgtctattattccagtttgtagacatgcatttattgcttaattgagttgctcttaacagacatttatattacttataatcttttgctgttaggagcaatactgcattgaataacccaatacatatgtcatttgtgaatttatgtaataaattcctaaaaatgtactggagtcagtggataagtgaatttgccatttttaaatatttccacattgctatctattacatttgtagctgtttacgtgatctttttagatgaaatacaactttggactaatttaacttggaattttcaaattatgagtcaaattgaatagtttttcgtatgttaaagcaccacttctgttttcttctctatgaactctgtaatctttgctcattttctgttgattgttggccccttttttattggtttggaggagctcttatgtactagaaatcctttttctgatatgagtttcaaattatttttgccaaattgtctcttaatgttgcttatgatgtgttttactgtcatttaaaaaaataagtttaacagctgtcatgtaccaggcactgtactgtgtgttccatgtgtattgtttcatgtaatcctcatagtagcctttgaagaggtactgtcttacgtttgagggaactggggcttagacagatcatagaacttgacaacatgtagtagagtggggattcagacacatttttggcagcctgaggaatgggaacttgtgaaggttgttctggtcctttgaaagttgtgtgccccattgtttgcctttatagcagtcccaccctgtcctcaacatgctaggccatagctgttaacattgaagttaacttctgaagcagcacatttgaccaaaacagtgtgcggtcacctttttctttagaaggaataaaagtagtcacccttgaaattcattaaagaggtatcgtgttgggactggcatgctgtctttcactaactgctgcagccagcttctctccaatgcccagtgatagaatgatacctttttcattttctctttttttagagacagggacatactctgtctcccaagctggagtacactagtgcaatcatagctcattgcagccttgaactcctgggctcaagcaatcctcctgcctcaggctcctgagtagctgggactataggcatgtgccaccacattcggctaattattttattttttgtagagatggggtctcactttgttgcccaggctggtcttgaattcttggactcaagccatcctcctgccttggcctcccaaagtgttgggattacatgcgtgagccaccatgcccaggctctttttcttcacgagctccagataaagtagttagtttctgtgtggaggccaagtatacatttctttcaataggagaagcactctccgtgcagtgagagtctacactctgagaagtacctaggactcaatccacctcccattcccccagggaacagtgcctttgctgctcccagtctcccagctcagccataagctcaggcagacaaaaatctttgcactattattatcgtttcctttttatttttggcccaaaatgttttaattgacttggcataagttgaatgtacatcttctggaactccactgtattaaaaaaaaaaatttaaaacaatctacatggagaattgttacgtgtttttataatttcataactggcgaggtgcagtggctcacacctgtaatcccagcactttgggagaccaggaccaatggatagcttgagcccaggaatttgagaccagcctgggcaacatggtgagaccccatctctaagaagaaaaaaaaaattttttttttaatgaaaaaaatgaaaaaataatttcacagccactttcaaaaacttaaagacaactcaacctccttgttttctatcactgaaatatttaatgttttcaacattctgattttataaaataagttgggaaaggaatctctactgttactgtagacaaaccagtgaacacttatgatgtatttgacatgggccacccttgggccctcagggattgagaacacaaagaggatatagttagtctactcagtaagcagaaaccacaccgctaatttgaacagggaaaattcaatattaagaattgttggggccgggcgcggtggctcacacctgtaatcctaacactttgggaggctgaggcgggcagatcatgaggtcaggagttcaagaccagcctggccaacatagtgaaaccccatctctattaaaactacaaaaaaaattagccgggcatggtgccgggtgcctgtagtcccagctacttgggaggaggcaggagaattgcttgaacctgaaggcggaggttgcagtaagcaaagatcacgccactgcacttcagcctgggtgacacagcgagactctgtctcaaaaaaaaaaaaaaaagaattgttggcgaggcacagtggctcatgcctgtaatcccagcactttgggctgaggcgggcagatcacctgaggtcaggagtttgagaccagcctggctaagatggcgaaaccccatctctcctaaaattacaaaaaactagctgacacagtggcgcacacctgtaatcccagctaccagctacttgggaggctgaggcgggagaatcacttgaacccgggaggcagaggttgcagtgagctgagatcatgccactgcactccagccagggtgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaaaatatttcatttattgtctgtcaacaccatgggagcagagatttttttttgtccagtttattcattgctgtgccacaacatcaagaattgtgccttgactgggtgtggtggctcatgctgtaatcccagcactttgggaggctgaagtgggagcatcacttgaaaccaggagttcaggaccagcctggagaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccaggtaagaacaggaggcctcaggaagagcatccctgtccatagggaggttgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcaaatgccaccccactagtgttagttatcacaggaactattccccacaattgatatacagttttttttctggtttttttttttttgtttttttttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgatatacagtttaatcacaaataagtgaggaggaaaagatatatataaagatcccagtttttccttcaagaatttcgctttttttgttttctatatgcaactttctacatatgggattcttttcctttttttctttttttggcgagacaaagtctcactctgtcacccaggctggagtgcagtggtgcaatcacagaatcacaggtaactggggtttcaacctcccaggctcaggtgattcccccatctcagcctcttaagtagctgggactacaggcacatgccgccatgcccagttaattttttacattttttgtagagatggggttttgccatgttgcccagcctggtctcaaactcttggactcaagcaatctgcccacctcagcctcccaaagtgttgggattgcaggcgtgcaccaccatgcctggcctacatatcagattcttgaaaacatagagaattcagtgtccaaaagttggacagttatcctacaccatgggttacaaatgtcagtgcttcaggggctagcagatcctgtgagagtgagtgagtgaggcaggctgggtaaggattgtggtaaaccagaaatctctagcccagtcaaagcggctgccacctctcagctttagcgcccgattaccatccaagtgggttaagttgtgacagtttctcgtgtttcaagagtagccaaaatcaagattttttttcatagaggaagtcatgttttaaatactagcaaaagtaatgtaaattttattactgctggaaaaaatacagctgtgagccagaggctgtccttttgattttaaaattttaggcagcttgttcagtaaagtttcctagggtttcatacatgtttcaagaatgcattcctgggctaggtgcagtggctcacgcctgtaatcccagcactttgggaggccgaggcaggcggatcacgaggtcgagtctgagatcattctgaccaacatggtgaaaccccgtctttactaaaaatacaaaaatgagctgggcatggtggcgagcacctgtaatcccagctagtcaggaggctgaggcaggagaatcacttgaacccgggaggcggaggttgcagtgagccaagattgcgccactgcactccagcctgggcgacagaaactcttgtctcaaaataataataataataataattcattcctgtaatgaaataattggagacacacacactcctgcttatgcagtggaggcagcactgatgaaactgaaactttggccagccaagcctgccatcatggaacggctcagtgtgttccttcaccagccagtgagcagagtctaaatggaaatgtttcagggtgttggggaataagtgtgtcttatagacagggatgacttttggagagtcatgactgccgttgtctgcaatcacaatgcccagagcattccatcttcttcattagctcttctatcctctgtcctgtcctctagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaaattttaaacatagctagaataacttaacagatattttcatgcttgagggggagagaagggaaatgttggataggtttcatcccagtacatggtagattctcagtacgtatttgataaaaagacaaattgaggccggatgcggtggtccatgcctgtaatcccaacactttgggaggctgaggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcgccactgcactccagcctgagtgacagagcaagactccatctggaaaaaaaaaaaaaaaagacaaattgaaagttggagaattgaattgatctagcaagtcaaaacattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtgggagaatcacttgagcctaggaggtggaggttgcagtgagccaagattgcatactgcactgcagcctgggtgacagggggagaccttgtctcaagaaaaaaaaaagaaattttacattaaattaaaagttaaatatgacataaaaagtgtggtagtctaggaaaaacagaaaccattcatcaattttccaagccttatatttactttcctacctccaaaaataaatacaaaaaccctggaggtaaatacattttttttccaagatggtggtgggattctcattattttgaactttgcatacaagtgatactttatataatttttgtattgttaatttttaccattactttttttttttttttttttgaggcagagtcttactctgttgcccaggctggagtgcagtggcgcagtctcggctcactgcagtctctacctcccgggttcaagcaattctcatgcctcagccttccaagtagttgggtttacaggcacatgccaccatgcctgactaatttttatatttttagtagaaacagggtttcaccatgttggcctagctggtcttgaactcctgacctcaagtaatccactcatcttagcctcccaaagttctaggattacaggcatgagccactgcacctggccttgttatcattactttttgtccccaaatatttattttaacccacaattaaagaatgtcatttttctctacagccttaaaatatccagctcttttatgcctttgcctgtaataagattttgtttgtgagagtcgtttgcatatctcttaagctgattggtactagtttgtttttaagaatgtgttcttttttttttattatttatttttttattttttggagatggagtctcactctgttgctaggctggagtgcagtggcgtgatcttggctcactgcaacctctagcctcctgggttcaagcgattctcctgcctcagcctcccaagtagctggaactacaggcacgcaccaccacgccagtggtctcactctcttgacctcatgatccacctgccttggcctcccaaagtgctgggattacaggcgtgagccgctgcgcccagcctagaattcttaagagctgttacatttgaaaagacaaaactaatggtttcgccagccaataagcaaagtctaaatggagagcaggccaggcaaggtggttcacacctataatcccagcactttgggaggctgaggcgggtggatcacttaaagtcaggggttcaagaccagcctggcaacatggtaaaaccccatctctacaaaaaatacaaaaattagtgaggcgtggtggcgtgcgcttgtagtcccagctacgcaggaggctgaggcaggagggtaacttgagcctgggaggtcgaggttgcagttagtcaagattgtgtcactgcactccagcctgggtgacagagcaagactgtctcaaaataaaataccaataaataaatgaagaacagtacagggcattgaaaaatgaagttatcttgtaatacagaggatgacttctggggagtcgtaactgccttcatctggtatcacaaacgatctgtattaagaatatatataaaatgtttcaggccaggctcagtggctcatgtctgtaatcccattcctttggaaagctaagacaggaggattgcttgagcccaggaatttgaaaccggccagggccacatagtaaaaccctctctgtacaaacactaaaaaattagctgggtgcggtggctcccgtaatcccagaactttgggaggccgaggcaggcagatcacttgaggtcaggagttcgagaccagcctgaccaacatggagaaaccctgtctctactaaaaatacaaaaattagcccggcatggtggtgggcacctgtaatcccagctactagggaggctgaggcaggagaatcgcttgaacctgggaggcggaggttgcagtgagccgagataatgccattgcactccagcctgggcaacaagagtgaaactgtctcaaaaacaaaaaaaaattagccaggcatggtggcacacatctatgttcctggctactcaggaggctgaggcaggaggatcattgagcccagaaattggaggctgcagtgagctatgatcatgccactgcactccagcttaggtgacagagcaagactatctcaagaaaaaaacagatgtttcatatttcataaaataactagatttctagtcatacacagttatcagcattatcttagaaatgtgcactaattatatgactgtctgatctctaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaacgtaagaaaattagtttctgattagatttctatctgctatatacaaaatgcatcacagcaatactgtggattgaaaagagtaagagaaaaatacatgctgacactctgacaaatttttttttctttctatttggtgactctcccatttcacttttcttaatgccctgaagagggcagagcctcatctgtttcactgttaagcccttgcttgagcccaggagtggaagggtgctgtgagctatgcatagaaacatggacagtgaaaagtgctccgagcggtcagcaggctggatggaagtcctgactgtggctagagccctgtggccttaggcaggttactatccctcttgggaccaggtcctctttagaattgttgtcagcaataacatcccatcattccttctttccaagaagagtgtaattgaaatcatataaccaggatgtgcctacaaaattatctagaaatccaccaatggggagagagtggaatactgatgaggaagccccagccagaaaagtaggtctttgtcactcagcttcctgggcatcagcaagattctgatgcctgagctttcttttcttcctctaaggtataaaaacagtaacacacagtgctggcaaatgtgtggtaagaatgcactctcctgcgtagctagttggagtgtataatggcatgatctttctggaaagtaggtgagactatataccaggagccctaaagtgttcattctctgtgactcagtaattccactgttatggaatctgcttcagaaaatattttagaaataggaaccaggaataccacatggaatattcactgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaaggtccacttcctgggttcaaccaattctcctgcctcggcctcctgagtagccaggattacaggcgcgtgccaccatacctggctggttttttgtatttttagtggagatggggtttcaccatgttggtcaggctagtctcaaactcctgacctcaggtgatctgccgacctccgcctcccaaagtgctgggattacaggcatgagccaccgtgcccagcctaaaagtgaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgtgtttttagtagagacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttacgagctcttcctgcctcagcctcctgagtagctgggactacaggcgagcaatttttcttttgaaatcttagcaaaaaaaaaaaaaactggaaggaaatatgccaaaatattgtcatgtatcccttagaatgatgtagctatttttctttataatttttttcataattttttacatatatcagttaccttacaatgagaataacaagtcataaagtgaaaaaagaattaattaattaaaggaggcaccaatggctcatttcagcttaagcccaaaagacaaatacctacagtctcataaagtttctctaaaggagatatgtagggccgggcgcggtgggtcacatctgtaatcccagcactttgggaggccgagccaggtggatcacaaggtcaggagtttgagaccagcctggccaacatggccctgtctctactaaaaatacaaaaattaaccaggcatggtggcaggcgcctgtaatcccagctactcgggaggctgaggcaggagaatcacttgaacccaggaggcagaggttgcagtgagccaagattgtgctgttgcactccagcctgggcaacaagagcaagactccgtctcaaaataaaaaaaagagatatgtaaatgtcaagtttttggcatgttttttaaaaaagcaattaaatgtgattgtgaggagagaaaggcagttatataattatgagtaataagctcttgtgctacagacattgattgagttcagccctagccatgtgccaggactgagccaagttatgacttaacatatttacttcatttaatcctcacaacaaccccttgagtttggactttttttttttttttttttttttttttttgagatagtctcactctatcgcccaggctggagtgcagtggtgcaatctcagtttactgcaacctccacctcctgagttcaagtgattcttgtgcctcagccacctgagtagctggaattacagatacgcaccaccacacccagctaatttttctatttttagtagaaatgggggtttgctacattggccgggctgtctcgaactcctggcttcaagtgatctgcttgcgttggcctcccagagtgctgggattataggcatgagtcactgcacctggccaggcaattttttatctccattttatagctgaagaaactaaggctcagtgatttgcccaagatagcacagccagagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcagaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagagtcttggtctgtcacacaggctggaatgcagtgacgtaatctagctcactgcaatttctgcctcccaggctcaagcgatcctcccacctcagcctcctgagtagctgggaccacagacacgcgccactatgcccagctaagtttttgtatttttggtagagacagggtttcaccgtgttgcctaggctggtctcgatctcctgagctcaagcgatccacctgcctcggcctccccaagtgctgggattataggcgtgaatcactgcgctcggccccaactttctaatagcaagaaaagcaccaatattgtaataagttccagggtgagattaacacttctgaaaaactggtgcccaaaaaaaaaaaaaattgtctaattttatctgtttctctcccacctcaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtatagctgtttctaatgtgtagtaatttaaaaaacatatatcaagccgtagttttgggtcagtttatgtccctcaccaatgaaagggggaaaattctagtcatgagattctttatatgcctcttgaatctattaactttgttgttgctagttacaaaatgtaattgtaaggatcaagtagtggctattggttcagccagtacacattgacagctttgaaatattcagatgctaatttatttatttatttttgagacagggtcttgccctgtagcccaggctgagagcagtggtgcaatcacagctcactgcagccttaaccttcttggttcaagtaattctcccacctcagcttcctgattagccggaactatagggccagtagtgagacaccttgcctggctaatttttgtatttttttgtagagttggggtttcaccatgttgcccaggctggtcttgaactcctggcctcagtgatcctcccaccttggcctcccaaagtgctgaaattacaggtgtgagtaccacgccaactgagatgctaatttttaagtcaatgtgacaaatactaatcagattcccataacagtgtttaggatctacataaatttgattctggacatagttctatacacaagggtaagagactgacagtgtaattccccaataattaaactaaaggtataattttccaaatcacttttagtaacacaataaattctaactttttttaaaaatagagatgggggtctcactatgttggccaaattggtcttcagctcctgggctcaagtgatcctcccacctcagcctcccaatgtattgggattataggtgtaagccactacatccagccaattctaactttttaagtctagggtctggcatggtgggaggattgctagaagccaggagtttgagaccaatctggggaatgtagtgagaccctatctctacaaaataataatagcaagtgtggtggcacacgcctgtagtcccagctacccaggagactggggtggggaggactgcttgagcccaggaggtcgaggctgcagtgagctttgtttgtgccactgcacttcagcctgggtgacagcctgtctcaaaaaaacaaaaaccaaaaaaaccttctggccacaaagcaaaaagttgcatagccacggtaaagatttagttggttataaagttgtagttattgccactttaagctaatacttcgttttggagcttttatacacagtatttttgttagggatcacagttctgcaacctctgctccaaaaagaatgagttttcttaaagggagcttaacttctgaagtcttagtgattcataggtgtgcatagaatgtgtgattccacatcccaggtggaaagaaagcaatctttccacctcagcctcccaaaatgctgggattacaggcacgtgccaccatgcccagctaggtttttgctgaggttaacctcttatctcttgtccctccctccaccacaaaaaccacaaacaaaaaacacttctacagcttccttcttcttggctgtctttgtcaatgtttccaatttttttttttaagagacgtgatcttgctttgtcacccaggctggggtgagtggcctcattgcagctgactgcagcctcaatttctcgtgcccaagccatccaaagttctttgttctattatgtggacagacacgaagggcatggcatttgttaagttctgttaaagtcttctctgcctctctcatgtctgtatttttgtggcccatgtcttctatgtggttgagttgttccccttgtttatccagtattgtgatgatcttgattcctgcatcctgagactcaatggctaaacccaggattctccttgtactttctagagactcatcagcaacttggtgaaccctcagatgaattctttttgattcaggatcttgctgtggctcccaggctggagtgcagtggcagtggcaccatcatagcttactgcagcctcaaattcttgggctcaagcaatcttcctgcctcagcctccccagtagctgggactacaggcacacctcactatgcccagctaatttttttaaattttattgtagagacagggtcttgctacgttgccccagctggtctcaaactcctaggcccaagtcatcttcccacctcagcctcctaaagtgctggaatttacaggcatgagccactggacttggccctgaatttcttttaatgacagattatccatgatgaatcaaaactatcaggcatgggccaggtgtggtggcttacacctgtaatcccagcactttgggaggctgaggcgggcagatcactagaggtcaagagtttgtgaccagcctggccaatgtggcaaaaccctgtctctacgaaaaatacaaaaattagctgggcatggtgacacacacctgtagtcccatagtcccagctacttggaaggctaaggaacaagaatcacttgaacctgggaggccaaggttgcagtgagctgagatcacaccactgcactctagcctgggccacagagcaagattcctcaaaaaaaaaaaaaaaaaaaaaaaattacttggctaatttttgtatttttagtagagactggctttcaccatgttggccaggctggtctcaaactcctgacctcaggtgatttgcccgcctctgcctcccgaagtgctaggattacaggcctgagacactgcgcccagcctctgaagacccacttctactgcacacctgtcataggcagaaagcagccctgggctcctgctgccctctgagagagtcctggaaggtactctgtccttggcctttgggccacattccatggactcctggtaaagtctcacttctcccttcccttccaccaaaagaggaaagaaggagaatttaatggctgggcacagtggctcatgcctataatcccaacactttgggaggctaaggcaggaggatcacttgaggccagaagtttgagaccagcctgggaaacggtgagaccccatctgtccccctccccatctccccatcaatgaactttagtactttctcctgctaggctttccatattgatcatgtttttgactcttgctatttcaaccattcttcagccattaattcgcacaataacccccgtaaagtaggtactattatcatcatcaccagcatccctcctttttatagaggggtacgggctcagagaggttgacaaacttgacttaggacactcagagggatttgaagccctgcagcctggctctagagcccgcctcctaaacattgcccagatctagcctggcaccgtgcctcacacctgtaaccccagctctctgggaggccaaggcaggcagattgcttcagcccaggagttcgagaccagcctgggcaacacagtgagacttgtctctatttatttattttttatttatatatatatattttttgagatggagtctggctctgtcgcccaggctggagtgcagtagtgcaatcttggctcactgcaattttggcctcccaggttcaagcaattcttgtgcctcagcctcctgagtagctgggactacaggtgcgtgtcaccgtgcccaggtaatttttgtagttttagtagagacgggatttcgccatgttgatcaggctggtcttgaactcctgacctcaggtcgtctacccacctcggcctcctaaagtgctgggattacgggtgtgagccatcgcattcggccttgtctctatttaaataaataaataactgcccagctccacttccaatttatttcttccactgcaaccttgatgctcccttcaagtcttgccctggagaggaatctcacacaggggaagggctgctctgatgtgctggagagcagatggacagcggtagataatatggggccctggctcctgtggacagagaacacacttagcacaggactaacatttgcaggctctagggcagaaatacaaatgtcggctcccatgctctgagggtcaacattgaaaaactatacgtaaaacttttgaataagacagtctatcttccttcctttataaatgtacctttgtaaagatctggaagggcaggtcaaagatggaattctcaggctcctcagagctccacaccagaaagcagcagcaccgggtggctggcccaagaccagcaccctgctctctccacctcaggcttcaccctgcaccataaggctttgcatgtgtgcatggaagcccattcctgtccaaactccctgcaaacccctttctgacccaagtcacccttccagcatgggagtgctcacaagctgctgtgcagcccaccctctgaagaagtgacccaggcaagggtatccacaggccagggccctatgggttgggaattccagggccctgtccaactgcagtgtggtctcaaagggagtggcatgggttctagatgtgcacacccattcggctaacgggcaggagggagcagctggaggagggccaggacgaagccctctaaagcaagggcacggcaaaggtctgcaggcttgcccaggtctaaggcaggtctaaaaatcccacttgaagggatggaaaaaatataatttcccatcaagaagcatgaaaaatacacttctaggtcaggcgtggtgcctcacacctgtaattccagcactttgggaggcggaggcaggtggatcacctgagctcaggagttcaagaccagcctgaccaacatggtgaaaccccatctctactaaaagtacaaaagttagctgggtgtggtggcacatgcctgtaatcccagctatttgggaggctgaggcaggagaatcgcttgaacctgggaggcggagattgcagtgagccactgtaatcccagcactttgggaggccaaggtgggtggaacacttgagcccagaggtttgagaccaacctgggcaacacagagagacccaatccctacaaaaaaaaatttaaatatatacatttaaaaatttttaattaaaaaaatataaaataaggaaatagaggacataatatattacctacaacttatatcctaattaataaaggagatttcccattttgtatgagtagatttgtttttttgagatggagtctcgctctgttgcccagctggagtgcaatggtgcaatctcagctcactgcaacctctgcctcctgggttcaagcaattctcctgcctcagcctcccaaatagctgggattataggcacacagtaccacgcccggctaattttcatatttttagtagagatggggtttcaccatgttgatcaggctagtctcaaacgtgtagatttttataacatataaacatatatttaaacagaaataagccaggtgcagtggctcacgcctgtaatcccagcattttgggaggccaaggtgggcagatcacctgaggtcaggtcaagaccagcctggccaacatggtgaaaccatctctactaaaaatacaaaaattagctgagtgtggtagtgggcgcctgtagtcccagctacttgggaggctgaggcaggagaattgcttgaacctgggaggcggaggttgtagtaagccaaaatcgcgccactgtactgtacagcctgggcaacagagtgagattccatctcaaaaaaaaaaaaaaaaattaaagtgcctccattttaaaaaagataagaaacaacaatcagatacttctcaatgtttagctgttaacactcttctgcatctcagttgggctttaaaagcgagattgagacataagacttgttctttcccagcataaccagatgtgtccacgcccttctggatccaaataaaatgtaaagttatcttcctcaaggagcacaccatagacaatgtgtcttttcagaatgtctttccttacattagacagattggggttttttttgtttttgcgcggggggacagaatcttgctttgtcgcccaggctggagtgcagtggtgcgacctcagctcactgcaacctctacctcccaggttcaagtgattctcctgcctcagcctcccaagtagctgggattacaggcacccaccaccacacccggctaatttttgtatttttagtagagatggggtttcacaatgttggccagactggtctcgaactcctgacctcgggtgacccatcctgtcctcccaaagtgttgggattacaggcgtgagccaccatgcccaacctagacagattgttttataagggtttagaaagaaaggaaactacatgaatgagtacttagtctcctgctccttgaagtggatgaattgttttctttggtttccaacacagtctgttaagagttgtagcacgccccaagagtatgtgcatgtagtggagctgggatggggaggattcccaagggaatctttagctgtcacccatgaaccatgcagagtggagaaggacactcagcctttctgtggctctcacctgcatgattattctggtggctgcaaagggcgataggcagtaggaggagacaccccgtgacaccaagagctgtgtccagacatgatcgtcttggcacagcttgagggttttctacagaaactggtagagatgctagacagacacaagatgccagccagcctcctttgcgattggctcttagaggtggaaaatggtaaagtcatcaggctcattctccctaggactagaggaacatgttaattatattaaagtagattagtgggccgggtgtggtggctcacgcttgtaatcccagcactttgggaggccgaggcgggcggatcatgaggtcaggagatcaagaccatcctggctaacacggtgaaaccctgtctctactaagaatacaaaaaattagctgggcatggtggcgggcgcctgtagtcccagctgctcgggaggctgaggcaggaaaatggcgtgaacccaggaggtggagtttgcagtgagccgagatcgcaccactgcactccagcttgggcaacagtgtgagactccgtctcaaaaaaaaaaaaaaatgcagattagaacgattaaaatgattactggtgattactggtactattgctgcaatagtaaaaatacatctttttcaccaatgtctttgtttttttttaaaatgttccaccgtcttctgaccatcatggtttatttttatttttattttatttatttatttatttttttaagacacagtctcgctgtcacccaggctggagtgcagtggctcgatctcggctcactgcagcctctgcctcccaggttcaagcgattctcctgcctcagcctcctgagtagctgggactacaggcgcatgccaccacatctggctaatttttgtatttttgtagagacagggttttaccatgttggccaggatggtctcgatctcctgacctcatgatccgcctgcctcagccttccaaagtgctgggattacaggcatgagccaccgtgcccggcctcaccaatgtctttcactcatgtatctttctccatggacttcacttatttatatatggcatttcattcaacatgcaacaaacatttattaagcagctactgtgtgcctagtgctgggggtacagctgtgaataccatcaatatggggctagatgtggtggctcacacctgtaatcccggggctttttttttttttgagatggagtttcgctcttgttgcccaggctggagtgcaatggcaagatctcagctcaccgcaacctctgcctcccgggttcaaacgactctcctgcctcagcctcccaagtagctgggattgcagacgtgcgccaccacacccggctaattttgtatttttagtagagacggggtttctccatgttggtcaggtctcaaactcccaatctcaggtgatctgcctgcctcggtctcccaaatcactgggattaccggcgtgagccaccatgcccagccctatcccagtgctttaggaggcggaggtgggaggatcacttgaggccaggagtttgcctgggcaacatagtgagagctcatctctacaaaaaaattcaaaattagccaggtgtggtggcaggtgcctgtagtcctagctactcaggaggctgaggtgggaggattgctttagcctaggaggtcgaggttgcaatgagctatgattgtgccattgcactgcagcctgggtgacagagcaagaccctgcctcttaaaagaaaaaaaaaaaaaaaaaaaaagccctggccaggcgtggtggctcatgcctgtaatcccagcactttgggaggccaaggctggcggatcacaaggtcaggagttcaagatcagcctggccaatatggtgaaaccccgtgtctactaaaaatacaaaaatcagcggggcatggtggcgggcacctgtagtcccagtaacttggggggctgagtcaggaaaattgcttgaacctgggaggcagaggttgcagtgagctgtgacagcaccactgcactccagccctccagcctgggcgacagagcaagactctgtctttaaaaaaaaaaaaaaaaaagaaaagcccttgctgtatagaatcccttaggttatggatggggaggagggcaggggtttaggaggggagaagcggaaggaggaacaaaataaagaagagacaattagttggagagtgataaataccataatgatatcatggaactaggcttaccagatcaaacactgggcacccagttcaatgtgaatttcagataagcaatgcatgatttttaagtataaatatgtcctacacagtatttatactagaaaattataaatttttttctaaaatttacattgacctgggcagcctgcattttatttgctaaacctggcaaccctaatttgtgtgctgggtggtggtgagtgggcaatttcagataggcctcttttgtggaggtgacatttgagctggaacctaaatgtaaagaaggagccaatcattcaggaatctagaacatcccagcacagggaacagcaagtataaatgctctaaagtggaaataagcttggagcttagaggaacaggaagaaggtggggtggcggagctgagtgagggtgaggagaggagggaagcggaaggtgatgagggcaggcaggctggcaggggccagatcccatatggtttgtgggctgtaataagagtaccaaaacttacataccaggccaggcgcggtggctcacgcctggaatcccagcattttgggaggccaaggtgtgcggatcacttgaggccaggagttcgagacctgtctggccgtgtctccctctaaaatagaagctccaagaggggcaggaagttctcttccgtcttagaccctatgtgcacgaccttggatcgatcaacattgaacacctcctacgtgccaagccctgacatcaaaatgggtcagaagccagcagccgctcgctgaatctgtgttcctctttggaaaacgagaaccgtgaagcctgctggcatggtcagagccaaagagcattgtcacttgtgagatcagcgcagaaacagagcggggccccgattggcccttcgaacttgggtggggccagagcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgaggtgaggcgcggggcgtgcacggcctaccagagtggctcttggggcccagctgaggaagggatgaggcgctcccggtactaacgagcgctagggagtgagaaccgcgcctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctagccgcgcgagctgagtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcatagactttggaattagatcgcctgggttcattccagacgtagcctctcgttaggggtgtaacttgaggctggtcacctcatctcactgagcctccatttccttagctgcaaaatggggttaataacagaatctacctcggaaagtggctttgaggatgcgctgagttatttaccgtggtttacaaaggttccctgggagctgacggttgtttattcatctctcccacccatctttctccttagccagtgtggctttctgtttcttccatattccagggttattccgatttaaaattatttgcacatgccttttgtttgctggggaagtaccaacatttttgcaaggcaggccgcctctcccaagtttccctcaccttaggcctcccctaaccaacctcttcttttgttttctttttctttttcttttctcttttcttttttttttttttttttttttttttttgagagagagagtctcgctctgcctcccaggctggagtgcagtggcgcgatctcgactcactgcaacctccgcctcccggattcaagcgattctcctgcctcagcctcccgaatagctgagactacaggtctgagactacacgccaccacacccggctaatttttgtatttttattagagacggggtttcaccatgttgatcaggctgtctaatcaacctgtctaggacctttctcccatggctctccatcaacatcacctggttttagttacttcatagcatttactaacacttacttattgcttacttgttatctttctcaactgctagaatgtaagctgtttgagagcaaggaccttgtctgtcttgcttacttctctctccctggtgggtgccatcccacctgtgcttgccacatggtagatgcacaagtattattcttccttggaggcacagaaggggaccctttagtcttggattccaccaattgctctttttctcaccttgggcccacatagtcatatctttggcctttctctgtgtgtgtctctctcttttttttttttttttttgacatgctttcagaggatcctaatggacctcgtctctccgctcctacaaccctttatctttcacttcttaccatcagtgcaagggaagtctctctccccttctgattacttctgctggttggggtctgggacaggattggatggatgcaagagcagtgctctagttttggaattaatttgtttctttattcatttaataactttattgagcatccacttaatctctgggaatatagtgaaaaaacaaaaatggacaaggtcccttcccttgaggaccatgtattctcgtgggcgaaagaaaaaacattagataatttcagatagtgacagaattatgtgacaggtgaagaaggcttttctgaggaggtgacatttgggtagagaccagccattaaaaggtgaggggcagaacattccaggtagagggaatagaaggctcaaggctcaaggacaggaaccggcttggaatattgaaatatttaaggaatatcttaggttcctagagtgttacatgaagaagggagaaatatccaggacccggatcatagaaggctttgtaggcaatgtaaggagtttggatttgattctaagtggtatattcctatggttagaaagcagagggtaggttgaggtgttgggatatgttcttcatgtgtgggtgccagatagttttcattcattggatctctttccctcttcccaaatgtaaggcctcgggaatggttctctaatgtgttgaggacatatctaagaaaaaggcagacatcttggatcagcttatgtcacagatgtctgtgagatggctttggaaaacaaagcttttattccagaaatctccacctgtaattgagggcctgtgggaagatgctagacttaggtctggccattcattcaacaagaagaacttggaaatttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctatcctcctacctcagcctcccgagtagctaggactacaggcgtgcaccaccacactcaactaatttttattttttttttgtagagatggcaccatgttgcccaggttggtctcaaactcctggactcaaccaatctgcttaccttggccccccaaagagctgggattacaggcatgagccaccctacttggccaaaatgaatgttttgtttctagtttgagtcatttttagatcagtaacactttttgcatttatatattgctaatatttcagagtgtcaaagtacctttacttgtggttgcataagataattagagcttgatcttgttgataattatgaatacctgtaaaatgttctctaaaagtccctgatttctcttattttctcaaattaaggataagcttagaattcggttttatagactatatctgcaaggcgatataaaaaggatttgttgacaaatagttccttaaagaatattcccaaagaataaactttggaaggccaaggtgggcggatcacttgagctcaggagttccagaccagcctgggcaacactggaaccatgtctacagaaacaacacaaaaattagccaggtgtggtggtgtgtgcctgtagtcccagctacttgggaggttgaagtaggaggatggcttgagcccaggaggcagaggtttcagtgggccagaattacaccactgcatttctccagcctaggtaacagacccagaccctgtctcaaaaaagagtattaagattctgggatctatgtagtattttaactttgagggattataacatgcatatttatataacccctcacttttttttaaacttaaaaatagtcctaccctagcatctcaacttaatcattttaggtttcattctattatgtggttttatttatttatttttattttattttattttattttattttatttttggagacagggtttcactcagtcacccatactggactgcagtggcaagacctcagcttattgcagcctagacctcccgggctcaagcaatcctcctgcctcaacttccctagtagctaggaccacaggagggtatcaccaagcccagctaatttttttttttttttttttttttttttgagatgggagtttcacttttgttgcccaggctagagctagagtgcaatggtgcagtcttggctcattgaaacctctgcctcccgggttcaagcaattctcctgtctcagcctcctgagtagctgggattacaggcgcatgccaccacgcccggctaatttttttttttttgtatttttagtagagacggggtttcatcacattggtcaggctggtctcgaactcctgacctcagatgatccgcctgcttcggcctcccaaagtgctgggattacagacgtaagccaccgcgcccggcctgagcccagctaatttttaaaattttttgtagagacaggatctcactattgttgccaagtctggtcttgaacggtccttggggtcaagtgatcgtcccatctccacctcccaaagtgctgggattacagaagtgagccaccttgctcagcctgttgtggttttagaatctagaaggttgtgtccacctctttctgtttgacacagtcaaccaaccaaaataaagatgaagaataatatttttgatggaaacatcaaaggtatctagctttttaaaatagtacaacaaatatataacgggtgctcatcactattgtaaggctctagggagagagcagtgaacaaagcacaaagtccctactatcagtggagtttacaatctagtgaagagagaagcacagtaaatgacaaaagaaattaatatgcctgataaaatgtacttggaaaatagtagagtaagggcatggagagtaactgaggtgaatgctcttttagataggatggtgcagcaaggcatctctgaaaaaaagatgacatttgaaaagagtccttccaggccgggcacggtggctcatgcctgtaatcccagcactttgggaggctgaggcggcagatcacctgaggtcaagagtttgagattagcctggccaacacggtgaaaccgcatctttactgtatataaaactcagccgggcgtggtggcacgcacctgtagtcccagctacttgggaggttgaggcaggagaattgcttgaacctgggaggcggggactgcggtgagctgagatcacgccactgcactccagcctgggtgacagagcaaagacccctgtctccaaaaaaaacaagagtcctgaatgagaatgaagtgggcagtgcaaaccttgtagctttccgtgtgcagagctctgcaggcagaaggaatggtaagtacagaaccctgaaacaaaagtaaaatcactggcatgtttgaacaggtaatacaggataaattttatcttttttcagagacagagtcttactctgttgcccagattggaatgcaatggcatgatcatagctcactgcagccttaaaattctgagcttaaccagtccttctgcctcagcctccagagcagctgagactacaagtgctcgccaccatgcctggctaatttttatttattgtagagacagggtctcactatgttgcccacgctggtcttgaaatcctagcctcaagtgatccttccgcctcggccttccaaagcgctgggattacaggcatgagccattctgccaggccagaacaaatctaaaaattcactttcttgaagtacttttgaataaacaaatttaattgtggcagttaagttggtcatttgttcatctgacattcatgcaactgagttcccacattatgttggggctgctaatgattgatctgaagggatagtctccagtcttgactggaaactcatgttttgctgggtgactgacatgttgtgacttatcctttagttcatacaacaaatgcttactaaatatgtactgtgtgccaggtaatgctgaaggtcctgagcatacagacgaaagtccctgccctcaggagcttgcagtctagtgtgtgtatgagacgacaaagaagtttatttcaaatgagggtaattgctaacacagtaaaacaaggatgatgtagatggtaatcgtagaaggcctttttgaagagttgacagtgggctgagtgctgaatggtgtccattatcaaattagaggatgagcattattatggtcagggagaactcttgtggccagtttgtagaacagaaggcttttgtgcctggaatgtagcaagagccaggaggaggtaggagatgaggtcagtagataccagattgcttagaccctgctgtggtaagggatttggtggtggtggtggtggtggtggttgttttggagatagggtctcactcccattgcccagtctgtagtgcagtggcctgatcacaactcacagcagtctcaatttgctggatctacaggtgtgtgccaccacacctggctaattttttgtatatttagtagagacagggtcttgctgtgttagcccaggctggtctgaagccggctgaagcaatccacctgccttggcctcccaaaatgctgggctaacaggcggcagccactgcacctggccaggagtttgggtgtttaagacaagtaattatgaggaatctaaggagttttagttgagaaatatacaaatgctagagaaacataatgaagaaagtgaaatgcagatttattaagaagtgtatttttaaaaatcaagaaaataagccctgtgtggtggcatatgcctgtagtcccagctattccagaggctgaggcaggaggattgtttgagctcaggagttagaatccaatctggacaatacagtgagaccccctgtctctcttttttttttttttttttttttttaaagacaaaatagatctgtaaatctgcccctgcaccctccccacccaagtttctaacaatctgccttgcatgaatccccaaaggtagaataaatttgcatatggcaaagaaaggccaatttcctttaactcagatacactgatgttaatgatttaacttgaccacagcaaactaacttttttttttttttttttttttttttttgagactgcgtttctctcttgttgcccaggctggagtgcaatggcgcaatctcgcctcattgcaacctttgcctcccaggttcaagcaattctcctgcctcagcctcccaagtagctgggattacaggcatgtgctaccaggcatggctaatttttagtagagacggggtttcaccatgttggccaggctggtctcaaactcttgacctcaggtgatctgcccctctcagcctcccagagtgctgggattataggtgtgagccaccacacctggcccaaactttcatgatttcataactgatccaccatttcaatacagaaaaaaggaataggaaaataaatggattaaatcattgctttccaaagtgtgttctattgaaaaggagttctatagccaaataatgggagagactgggcaatcctcccaccttagcctcccaagtagctaggactacagggccacaccaccacgcccggctaattttttgtatttttagtagagatggggttttgccatgttgcccaggcaggtcttgaactcctgggctcaagcgatcgtctgcctcagcctcccaccagtggagactctggattaattgatgtgaaccagtaactttgtgagtttaaagtgctttgtattgtgaatctccaaagtggggcaggatataatgtgtagcattttccaaacttgtgatataaaaaaccataaagggtatagcctctcaatagattgtatgtgtggtttaatgggacttgattttcacacctatagagtggaacacctggattagagggagtgattaggtaggtggtgggatctactcagtcagaacattagcttcctgtgataaacacattttctaattaaggggaaggactgcagcatgtagaatacagataattctctttagaaggttggggtttctggctgttggggagtgccctgcataagcacagcattagataatattttcttattttctggctccccaccgctcagttgtcctctggctgccctcttttcacatcagcctttctattgtgttgtgagtgctttcactcttggtcagccgtctgtcatttccacctaagaggcagccttgggtaatagaaagagggtagacctacggagttggactgatttaaatctgatctttatttattaaccatatatagttaatatatgtcaacctgagtgcccttctttgtgtgtaaaatcattgtgtggaataaatgatatgaagcctatgaaaacatctagcatcgtgtgcctggttcatacatgtgacacttcccccattctgcaaaccattaccagcccaaaggtcctctactccactttcattacatttttacccacttaagaaaaccttcatgacttccccatacattaaatcatggcactcttcagccaagtatggaggaacctatatgatctggtcttgatctcctagcccactattctctcttcccatctctgttactttgctctcacaattcattttggcagatgcgccctcatcctactttgcctattcagatacacatatttttcaaggttcagctcaaggctcaggctctgggaaactcttggatggccacataaccccgtgactcccttcttaattttctaacgtttaaggtgctgtctttgtgattcatttggcacttcagaggacagatgtttcagaatttgggattttttttggatgcatgtactgtggattatacaacatccccagtggggcttggggtagcaccctgtaatcaaacgtattgatatttctttagtgaaacaaatttgcatactaagtgagataaatctatgttgatagcctcaggcagttcaggctggttttgctgccaagtgagtttgccacaaacttgttaaaaaacaaacttttaagtttttttatttttggatttcatcactttagtaaagggtatataggcctgtacttggcatttcagttgtgtcttgtcttctgaactattacagaagctccttctaggacaggaacttgattgcatattgtcataggcattttaaaaataaatgggtcccggtatggtgggtcatgcctgtaatcccagtgttttgggatgccgaggcaggaaaattgcttgaggtcaggagttcaagaccagcctgcgcaatatggtgaaaccccatctctacaaaaaatacaaaaattagccaggcatggttgattgcgcctgtagtcccagctactcaagaggctgaggtgggaggttggggcttgagccctggaggttgaggctgtggtgagctatgatcatgcccctgcagtccaacctgggccacagagcaagactctgtctgaaaaaataataaaattttttaaattccttactgtaaatgtataatagatatgtgattgtaagattagaaaagtatgaagagaataaaactctccttatatctatcaccgagatgttatcactgttctacattttggagtgtgttttttgttttcttctatatgtgaagttttttttcataatttgaattatgatatccttgaactttttccactgaccttttttacattttacaaaaattgtgtgtttagtttttttcttctttttcatagaagcctctggttaatttggtgcatgatttccctgaaagggctccactttcccatctacatgtggctatatatctaaaagctgcctaatggaatctaagcataagtggagttttctaaaatcgctttttttttttttggagacaaagtctcgctctttctgaggctggagtgcagtggcacaatcttggttcactgcagcttctgcctccaggttcaagcgattctcctgcctcagccacccaagtaactgggattacaggtgcatgccaccatgcccggctgattttgtatttttagtagagacgggattcaccatgctggccaggctggtctcaaactcctgacctcaggtgatccacccccctcagcctcccaaagtgctgggattacaggcgtgagcaaccgcgcccagcctaaaatagctttattgaagtacaatttacatactataagatttatccattttaagtgaactgtttgggaaatgttagtaaatttatgtagattatgcatgtgtcaccacagtccaattttagaacactctgtcacccccaaaaagttccctcagtttgcacctaattttatcgtctcaccaacaagttggagaccataaagctcaattgataagattcccaggatttgtgatctgttggtaatcatgcacatctgacacttgtactctgtgtatgtgctgtttctgtgtgttttttcattttccttttaattgagtgggttcagactcctttttttcccatttttaatggacaaaattgtatatatttgtggtatgcatgttttgaaatatgtatacattgtataatggctaaatcaagctaattaacatattacttcacatgctgtgtgtgtgtgtgtgtgtgtgtgtgtgtgtgtgtgtgtggtgaaagcacttaaaatatacccagtaattttcaagtgtacaatacattattatagtcaccttgttgtacaataaatctcttgaactgtgtatttcttagcctatgttgttagtagttaaatcgacgtaggccatttagttagcttaaaatttgtgggctgggcacggtggctcacgcctgtaatcctagcacactgggaggccaaggcaggaggatcacttgagtccaggagtttgagaccagcttgggcaacattgtgagaccctgtctctacaaaattttttttttaatttgtcatctgttagatgtgaagttttttggtcagttataagcatattatgtgatttagttttgtttaagctttaaatatgaaaacttctagaatcataatcttagctgtcatcttctgaactctagaatttatctccctagatgcaaattcttagcactttgtagtatttgcgattacatgttgtacatgaaggaatttcttgtttctttaatctcagaactttatgtgggatatttatttgctgtttaaaattttaatttctcgttgtggggccttttttttttttttttttaagacaggtcttgctccatcacccaagttggagtgcagtggcaccatctcagctcactgcaacctctgcccccaggctcaagacatcttcccacctcagccttccgagtagctgggactgaaggcacccactaccatgcctggctaattttttgggttggttggttggtttgttttgagacggagttttgctcttatcgcccaggctgcagtgctatggtgcgatctcagctcactgaaacctttgcctcccgggttcaagcgattctcctgcctcagcctcccaagtagctgagattacaggctcctgccaccatgtccagctaatttttgtatttttagtagagacgggattttaccatgttgaccaggctggtctcaaattcttgacctcaggtgatccgcctgcctcagcctcccaaagtgctgggattacaggcatgagccaccatgcccggcttcaatttttttgtagttttggtagagatggggtctcaccctgttgacaggctggtctcttaactcctgagctcaagcagtccacccacctcagcctcccaaagtgtcgggatttacaggcctgagccactgcccgggctccttatggggcttctttaataagttcctccagtgattttttttttcttaacctttattagccctttcccatagcattaaatcatataaacttcttggtgacttcgagcagtccttcagcttttttttctatgactatctttttgaaattttgggattttttttcatctcccttatcacaaaattgtctcactattgtttttgggggaaaaggcacatctcatttgctggactcttgtctcagagtcaggtttactgcccatataaaaaacaacagatggatgactttcagagagaataacccataatataaacggatttctttaaatgtaaatcactttttccgtaagtgaccagttatccaaaccttattttatattttagatcctatagcaatggaactcagcgatgcaaatctgcaaacactaacagaatatttaaagaaaacacttgatcctgatcctgccatccgacgtccaggtaaagaaaataaacgttttttggttgattaattccttcaggacaggtgagagaaacctatgtattatctgcctccttataaatatattttaaaaaattcatacttgggttctcaagcgtagtttataagtgttacagctgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggcggatcacgaggtcaggagatggagaccatcctggctaacacggtgaaaccccgtctctactaaaagtacaaaaaattagccgggcgtggtggcgggtgcctgtggtcccagctactcaggaggctgagtcaggagaatggcgtgaaccccggaggcagagcttgcagtgagccgagattgcgccactgcactccagcctgggcgacagagcaagactccgtctcaaaaaaaaaaaaaagcctgctttagagataaaataattagggcatagaaaggagagtaattgcctaaaaagtgattaagtgaatgaagccaagtaatcagttactgtctcttaattttaattttctattgggtttgatttaactaatatattttaagacctagagctttttttttccttcctgaatctgaccagattccattaaaaacgtagaattaaaatattgaactcaggtgttcacaggactcagctgttaagttaaatgagggagataggccaagtggagactggtaatatcaggagaatacatgccctgattaagtggcaagtactttttggaactagctaattttggggattcagactagttttgcaagatcagatttccagttttgcttgaaaaataaggatatttatatgaagtgccctcatttttaaatgttagcaagtaacttcaaaagattttggggccgggtgcggtggctcacgcttgtaatcccagcactttgggaggccgaggtgggcagatcacgagggcaggagatcgagaccatcgtggctaatatggtgaaaccccttctctactaaaaaatacaaaaacttagctgggtgtggtggcacacacctgtagtcccagctgctcaagaggctgaggcaggagaattgcttgaacctgggaggtggaggttgcagtgagttgagattgcgccactgcactccagcctgggtgacagagcgagacgtagtcccaaaaaaaaaaatattttgaaacacagccagggttggtggtcacgcctttaatcccagtaatttgggaggccaaggcaggaagatcccttgagtccaggagttcgagaccagcctgggcaacaaagcaagaccctgtctctacaaaaaatttaaaaattagccaagtgtggtgatgtgtgcctgtattcctagcaactggggaggctgagacaaaagcttcacttatacccaagaggtcggagctgcagtgagttatgatcatgtcagtgcactctagcctgggtgacagagggaaatcttgtcttaaaaaaaaaaaaaaaaaggccaggtgcatttgctcacgcctgtaatcccagcattttgggaagccaaggcaggcggatcatgaggtcaagagatctagaccatcctggccaatgtggtgaaaccctgtctctactaaaaatacaaaaattagctgggcgtggtggtgcacggctgtagtcccagatacttgggaggctgaggcaggagaattgcttgaatccaggaagcggaggttgcagttaaccgaggccactgcactccagcctggtgacagagcaagactccgtctcaaaagaaaaaaaaaaattggacaggcacatttgctcacgcctgtaatcccagcactttgggaagcccaggagggcagatcacctgaggtcaggagtttgagaccagcctggccaacatggtgaaaccctgtctttactaaaaatacaaacattagccaggcatggtagcatgtgcctgtaaccccagctacttgggaggctgaggtgcaagaatcgcttgaacccaggaggtgaaggttccagtgagccaagattgcccaactgcactccagcctaggtgacagagtgagactttgtctcaaaaaaaaaaaaaattgaaatacagtgcaagccaaactacttctgggccagatatatcttgtgagcagtcagttattgatccttgatatgggccatattaaaatgctcttgacctgtttcttcaaaacttaccaatgtgcatgctcatagaggatgttggaagggttccatgaggaagagaatgtgtgttatatattatgtatgatgactagaatcatgaacatgttaatgcatctatcctcttctagaaaagtctttgtgatttttgagaggaaaaattagtttattagtgtataaagaagtaatgtgttcctggataaagggaagttaatggctctaatctttaatcttcttagactttcaaagaaagctgttgccaacactattaaaaattttttttttttttttttttttggagacggagtctccctctgtcgcccaggctagagtgcagtggcgccatcttggctcactgcaagctccgcctcccgggtccacgccattctcctgcctcagcctcctgagtagctgggactacaggcgcccgccaccatgcctacctaattatttgtatttttagtagagacagggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggcgccatcttggctcactgcaagctccacctcccgggttcaccccattgttgtgcctcagcctcccgagtagctgggactacaggcgcccgccaccacacccggctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacagagtataaaaataatctggtatttctgggaagttaggaacatagcatttctcagggatcgagactgactgactagactgactcaactagaccttttgagactccttgagtgcgcagaaacatatgcatgtgaatattgtgataagttgaaagaaatgaacacagaaaggaacagactcaaactcacttcctggatattgattacaatttaggaaagagacttggcaatttatatgggcttttcctcaaatcatggatgtagtgtgttgccctgtacaaaatgctggctactaagtggaggaaacaaattgttctgtactcatataaaaccatagtatgtcccctcctgaaaaacatttttcagtttaacaatcttcatccttcaagaaagacatgataagcacaaagcaaggagagtttgaaaatatcagtgaaactcttgggactcagtcagaaagagggaaggtgttaaatgatacatgaaattaatttttcaaaaaatattggaatattgggtgttgccctatgaagccaaaggtagaaaaaaattaagagaaatactgtactgccatcacatgtgatcattaacctaggaaatttatcccagaatgtaatctgggttgaaaatctattggtaaattttttggataaattcattgctggtattaagaagtttttaggtttttttttagttcgacaagaaagcttagggctggtaaggtaaaataaggactgcactaaaactttcagtagtgaagcctagctgtgtgatcttgaacaagttacttaaccttagtgccttggttttttaaatgctatctacttttctgggtaatagtgacaactaaatgaaattttataattttacatatataatatatatgtaaatcgttggacccatttggctaataataatatattaggatgaattgactcatttgctcttcatcactagcctataaaagaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagataagaaaagtgaggccctgtagacccacaaataacctaatcttttctctttttttgatttttttttatatatatatatttgatatatataaggtggaaagatttttatcttagtcttttaacatgaaaattcttttacagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgtaagtattttgtgaatacataatttaataccctgtatgtttataaggtttatataagcagtgttcttcaaagataaggcacgtgcttgtagtcccaactactctggaggctgaggcggaaggatcacttgagtccaggagttcaaggctgcagtgagctatgattgcaccactgtactctagccttttagtgacagaatgagaccttgtctcaaaaaaaaggattcagatatggatcaaagataaaattaaacaggacccttttccaaagcttctgttatttcatttgaatttatataaatttgtccagcttcatacctcgggttgctagggagtgagacttggtcttaatctccattatgtttggaatttatgctttactcaccgcctactgaagagacattgtgggaagacagtctgaataaatgaagtgatttctgatgttggaaaaataaagctgagaagaaatcagatacataaaacatttgcagaatgcaaaataatttagatttcaactttttgataaggtattttgccctatgtcttgtgggatatgtatatatatactaattttgagattaaacctattttataacaggtttaatgattagtaaattataaattaagaaacaggcattttttttccttagcttaggacagtgattctcaactgggggcagtttggctcaccaggggacatttggcagtatatttggagacatcatagctggaggattgctactggaatctagtgggtagaggccagagatgctgctaagcatcctacaatgcacaagatagctttccacaacaaagaattatctgagccaaaatgtcagattgagaaagcctggctcatgatagagaaaaagatgaggcttttctatagtgatagcagttatgatgttacaaagtattagcagttgacaaaaatcatcagtttatctaaaaagtcaactttaaactgctcaaaaacatcttagagtcttactttttttctcattccataaaagagagagtaaatattgttttaagcctgtatgatttctcaagtatcaccatgagtggtaaagaaatcttagaggccgggcttggtggcccatgcctgtaatttcagcactttgggaggctgaggtgggtggattgcttgagctcagcaattcaagaccagcttgggcaataaagtgagatcccatctttccaaaaaatacaaaaattagcgaggcatatggtggtgcacggcctgtagtcccagccattagggaggctgagatgaggggatcacttgtgcctgggaggcagaggttgcaatgaactgagatggtgccactgcacttcagcttgggcaacagtgccagacactgtcttttaaatctcagaatgtttaaaagtccatctctactggtagacatgccagccctctccctctattttgatttgtaaaactagtgagacttaacagaatctctttgggtgatataatctaggatgcattctaactagtaatggtcaagaaattttcacagagggctgggtatggtggctcacacctgtaatcccagcactttaggaggctcagatgggaggattgcttgaggccaggagttggagaccagcctggacaacaaagtgagacccctcttctctacaaaaaaatttaaaattagccaggtgtggtcgtgtgtggtgtgcatctgtggtccttgggaggctgcagtgggagggattgtcttgagtctgggaggtgaaggctgcagtgagccaaggttttgtgctaccctccagcctgggtgacagatggaaacccagtctcaaaaaaaaaaaaagaataaaaaaaattggaaagatttttgttctaaagtgagagttaaattgaagcttttgaggatgtgtatggattaagtagcatatatctgtaaagattttaattatgtgtcctgattagtttacatatgaaatgaaaaaaaaatttttttttttttttttttttttttttgagagggagtcttgctctgttgcccaggctggaatgcaatggtgcgatcttggctcattgcagcctctgcctctcaggtccaaatgattgtcctgcctcagcctcctgagtagttagtgttacaggtgcccaccaccatgttcagctaattttgtatttttagtagaaatggtttcaccatgttggccaggctggtctcaaactcctgaccttgagtgagccatcgcacctggcctaaaatggaaattttttttttttttttttttttttttgagacagagtcactcttgttgcccaggctggagtgcagcggcaccatctcggctccctgcaacctccacctcctgggttcaagcaattctcctgcttcagcctcccgagtaactgggattataggtgcctgccaccatgtccggctaatttttgtatgtttagtagagacatggtttcaccatgttggccaggctggtctcaaactcctgacctcaggtgatccacctgccttggcctctcaaagtgctgggattataggcgtgagccactgcgcccagtctaaaatggaaattcttaattggcatcaaggagtaagggaagttcactaatttgtatgtaaaatatttgcatttgggaggcaatgtacgtttttctgggaaaaggattcacgctgtcatcagattattgaaggaatctgtgacccattcatgtagagggaaactgaagaaagaccaaaccttcctctatttgttttcttagaaaattagtaaataaaaaaacagttatgttttacctaaaatcatgtggacatgaatgtggattttgtgttacttcctcagttactgctttgcttttaggttgaagatgaaccaaacaaaatttgtgaagccgatcgagtggccattaaagccaacatagtgcacttgatgcttagcagcccagagcaaattcagaagcaggtaatgtcgctccactttttagatgggctcctctgtaaagctctgatctaattaatcttttcctctcctagttaagtgatgcaattagcattattggcagagaagattttccacagaaatggcctgacttgctgacagaaatggtgaatcgctttcagagtggagatttccatgttattaatggagtcctccgtacagcacattcattatttaaaaggtattgatgcatagattcatgtttttaaaatactttctaaagttttatttgcttgtgtaaacagttgtgtttttgtgactgttgtcattcctttgaatctgatcatcttggaatgagagcagaagtttctgtattgcgtttgtttcttctcaactaggatgtttatttcatattgctctattacctgtgaaatacttagtcttgataaactgcttgatccctttaaaaagaaaactggctgggcatgatggctcacacctataatcctagcactttaggagggcaaagtgggcggatcacctgaggtcaggagtttgagaccagcctggccaacatggtaaaaccccgtctctactaaaaatacaaaaaaaactagccaggcatggtggtatgtgcctgtcatcccagctactcaggaggctgagacaggagaatcacttgagcctgggaggtggaggctgcagtgagccgagatcaaaccactgcactccagcctgggcgacagagcgagactccgtctcaaaaaaaaaaaaaaaaaaaaaaaaagaattccctttgaatttcggaatttcggaaacccatctattcatagatgtccaatcagcatctctccttgaagacctaaagtgagtaaataaaaaaaacttgtaaatttatctgttttaccttaattttctagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagatttaaagaaatatatatatactttttttcttttttcttttttaaagacagggtctcactctcattgcccaggctggagtgcagtggggcatgattatagctcactgcagcctcaactacccaagctcaggtgattctcccacctcagcattccaagtagctgggactacaggtgcacactaccatgcctggctgctttttctctttttttttccctctctctttttttttttttttttttttttttgagatggagtttcgctcttgctcactgcaacctccgcctcccgggttcaagcaattctccgagtacactgggattacagcctgtgccactgggcctggccagtaaaacctgttaatcgcatttagaataataaagaattggaaacaacctaaataccaagtggcagatgaattgtttaataagagcatataaagatagttttgtgtaatatatttttatatatgcacagattgggaagacgtagttcagaatattaacactggactttttagtgccattatgaacagttcaaaaatacatactttaacctattttccacaatctcttaagtgactgtattatttaaaagccaaggctgggcatggtggctcacgcctgtaatcccagcactttgagaggccgaggcgggcggatcacgaggtcaggagatcgagaccaccatggctaacgtggtgaaaccccgtctctactaaaaatacaaaaaacaaaaacaaaattagccgggcgtggtggcaggcacctatagtcccagctacttgggaggctgaggcaggagaatggtgtgaacccaggaggtggagcttgcagcgagccgagattgtgccactgcgctccagcctggacgacagagcaagactccgtctcaaaaaaataaataagtaaaatatgaatagtctcagcttagtgcaaggctgtttcactaagatcagcatgctgggtttatgatgcactaaaaccatgttgctaaattcctttccaaggccactattgaactctgcagtacccatgcaaatgatgcctctgccctgaggattctgttttcttccctgatcctgatctcaaaattgttctatagtttaaactttcaggtaagttcatttgatttcttgcttttggttcttactctttgattttaaatagagttttctttctgtttgataaagacttctttgccagcattgatttttctgaaagaaaaggttttttctgactctatttatctatagtgttctgttctacagtagttctttcagatgctaatgagatgtttcatggaaaaaagcagtattctcttatatctagtaggttagcaaaaccccacatcctaactcactcttggagagtcaccctgtacactgttttactggtggcattaagaagctagatttctgaggccttcctctttcgttcatttatatgggtattaacatttggggaatcatgttttggttaggggttgctgtccagcttatacaaaatgacttttattggaagccatatgagggagacaaaagacttgaagtaccagactttgaaaggggtaggaactagtagtatttcagaggaaacatagccacagggctatagcagggaatgcctagttaccctgttgctactgagatagtggcctccaatcattctttctgttcttaatcattaattcaagattcaggaccaagaaaggggtgttaattggtacaaactgttgctatactgcgatgcaaggagggcctagcccattcattgtttgtagccagtacctggacttaccttcacaacatgaataaactcatagtggtagggaaagcattccccaaaaggaaattgggttgttttagctagaataggagatgaacagcccaaaaggacatgtcccacatcagtgttcagctggatagcagtttgagaagttcttacttaaatgagtactactatttttgcttacaccttttgaattctgagaagtcaggtttaatgaagctcttgagaacttgtctggcagggagaccaaggaaagaggcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagatgtagctggagcagagaattcttgtcagaataggtaatgctcaggctgtgaagcctgtgtataaaatgttttgtccacgtggtaagggaacttataaaagtggtgttcttaatattttaatcaaaagtttcaagtcagtgtttattctgtaggatctccctgaattttttgaagataatatggaaacttggatgaataattttcatactctcttaacattggataataagcttttacaaactgatgtaagtatttaaaatgttgcctgagtggtctttttctttcattaagagttatttggctacagtctggaaacctatttactcttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccaggagggcaaggctgcaatgagctgtgaccatgccactgcactccagcctgggagacagagggagacctcgtctcagaaaaagaaaaaattatccacagctcgagaaagagagaaaatggtaaaagattgtaatttgtaaatatttctgatatgggttttatattgtgtacttttaaacatataacacttattctgtgctactcatttgttaatatatttatgaccttctttccgaagagacaaaagacaaaatattaaaaatatttcaataccaaataaactaaaaattagaattggtgattcaaatcaggttttaagagtggggtacagaaagaaattgttactatcgttgtacaacagattttgtctcagagtttgactatattaataggaactttaaaagatgtagctctcataaaataattatttcagtccaatgggagggaaaaacactccttcagaaaacaaaacttttcttcacacaaaagtcacaaggaaattttttggatagaattcttacaaggacctttttgcccagttaaccatgtgctaccttgtgctactatttatgccttaagtaatcagtgtgagggagttttggttttggctttggtttttgttcttactctgatgtcttcccttgtctcactctgtcaccaaggctggagtgcagtggcatgatcatgacttactgcagcttcgacctccctgggctcaagtgatcctcccacctcagcctcccaagtagcagggactatgggtatgcaccaccatgcccagctgattttttttattttgggggcttgctgtgttgcccaggctagactcaaaactcctgggcttggcccgtcgcagtggcccacgcctataatcccagcactttgggaggccgaggccatcctggctaacacggtgaaaccccgtctctactaaaaaaaaaaaatacaaaaattagccgggcgtgatggcgggtgcctgtagtcccagctacttgggaggctgaggcaggagaatgacgtgaacccaggaggcggagcttgcagtgagctgagatcgcgccactgcactccagcctgggcaacagagggagactgcgtctcaaaaaaaaaaaaaaaaaaccactcctggcctcaggccatcctccagcctcagcctcccagagggttgggattaccggcgtgagccactacactcagccagaatatactgtttgaatctaatacggaaatattttgtaattcagcaacttatttgaaagacttggtgaaaagattggtggtggcatagctgtagtttacaataactgatttgatttggatttaattgataaagagtctagttcaggaatttcagttactcctcttacttatgttagcattagagttgtatgttggagtttttgttttcttttatgtgaggatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttggtaagatgatggtggagacaaataattaaaagacattctctccctatctcctccaagaaataagctgttgagttttgcttttaaaaatattcttgtttttgtgttttgttccagttggtaagtaatgcaattcaatttctggcttcagtttgtgagagacctcattataagaatctatttgaggaccagaacacgctgacaagtatctgtgaaaaggttattgtgcctaacatggaatttagaggtaattatggcaaaagtatattagtataaatctactaagtctgtgtttgttttttgtaacatattcagtctaattcatttattactggataaaacttgtatgtcatttatttcttattttctaaaccaagacagaaaatgtagtatctgtaatgagttttgttgtgccctgtgagggttttctcatggaaatattaaataagacttcaaaaattcctttacactaagaagataaactatctggaatttctatttagagaaagaatttgattttgtttcatttattatttcaatgaatttttagctggctttatttatttatatatttatttgagacaggggtctcgctctgtcacccaggctggagtgcagtgatgcaatcttggctcactgcaaccttagcctcccaggctcaagtgatcctcctacctcagtcttctgagtagctgggaccacaggcacacatcaccatgcctggctaatttcttgtatttttggtagagacagggtttcaccatgttgttcagggtagtctcaaactcttgagctcaagcagtccacccgctttagcctcccaaagtgctgggattgcatttctgagccacctcgcccagaaatagctgtttttaaacaatcgacttgagaatagaaatgataactttataaatacaaggttgaagcccacttagtttgtgcttaaggttaaactatagtgctaagagcctatatttataaaatgtatgtccttgttctaacagttgtgaagaacaagtaatgaaggtgggagggattgtgttttttgttttggggacagggtctcactgtgtcacccaggctggagtgcagtagcacagttatggcttactgcaacctcaacttcccaggctcaagtcattgtcccaccctggcctcctgagtagctgggactacagacgtgcaccaccatgctcagctagttttttattttttataaagatgggggtcttcctatgttgcacaggctggtctcaaactcctagcttcaaacaatccttctgcctcagcctctcaaagtgctgggattacaggcatgagccaccatgccaggccaagattttgttttatatcaaaatagttattagatcagtggttttcaaattacatctggaacaaaataaggaaattaaggacaatatagcgtgagattttatttcctgttgtgttttcataaaaatatgtttaaaggataaatcttctggctgggtgtggtggcccatacctttaatcccaacactttgggaggctgaggtgggaggaacacttgagcccaggagttaaagaccagcctggccaaaatggcaaaaccttatctctacaataaataaattagttgggtatggtggcatgggcctgtggtcccaggtactcaagcagcttaggtgggagttttgcttgagctcaggaggtggaggctgcagtgagacatgatcatacaactgcagtgtgtgtgtgtgtgtgtgtgtgtgtgtgtgtgtgtgtgtgtagacttttttttttttttaatttatatgataaaaatagagatgagatctcgctgtgttgaccaggctggtctcaaactcctgggctcaagcgatcctcccatttcagcctcccaaagtgctaggttacacgcgtgagccaccatgccggccatttctgacattgtccactctacttatttgttgttgaaatgactttaatgaaataatagtgattaaaattaggttgttggtattttaatgttcttatttggtgaaattaaaagttagcattctgatactgatccctaacatttttgacagttgcaggtataatccaattctggggaaactgtcacattagaacaagtgagcctatctcatagttgtgtgaattacctaatacctcacctttcagggtagcatttgctgctctagataatgattaagagtatatgaagtagtcatctgatgggaacgaattctttgctgtagaacaaggcagttttacatactcttctgcattctcagctgtaaagtacagtgacgtcttttggagtgttatctgaaatatcatctctccttgtagctgctgatgaagaagcatttgaagataattctgaggagtacataaggagagatttggaaggatctggtgtgtatcttggttttttagttactagtctcttagcaagccagttttaaggtggttctctttctagtaaatgggagaagtgggattgagaataagagtgttttttcagcgggctttcattgagaactgttgtctttcttcaacttgtcttaaaaagctcttatatgacctgaatgaaaatatcaaaagttgaatcatttgtctgttcttacatagtatttatcaaaattctgtgattctgtgacctctttagtttcattttgattttgtatttcttgggggcgggaatgtttttttcattgtttgtgttgctgatagctattgggtggccctttgtttttcgttcttttttttccgttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaaggtaaatatttttaatgtggttttgtttctaaaacagacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttttatatttttgagatggagtctcactttgtcaccaggctggagtgcaatggcgtgatctcagctcactgcaacctccacctcccgagttcgagcgactctcctgcctcagcgtcccaagtaactgggattacaagtgtgcactaccacacctggctaatttttgtatttttagtagagacaaggtttcaccatattggtcaggatggtctcaaattcctgacctcgtgtgatcctcacacctcagcctcccagagtgctgggatacaggtgtgagtcaccgtgcctagacagtatagtcttattttatattttatacataagcaggttgtgttttgttgttgttgttttgttttgttttgttttgagacggagtttcgctcttgttgcccaggctggagtgcaatggcacgatcttggctcaccgcaacctccgtttgccgggttcaagtgattctcctgcctcagcctcccgagtagctgggattacaggcatgcgccaccaccctggctaattttgtatttgtagtagagatggggtttctccatgttggtcaggctgttcttgaactcctgacctcaggtgatccacctgccttggcctcccaaagtgctgggattacaagcatgagccaccatgcctagcctaagcagttcatgttttgaagtgtccctctctctctttttttttttttttttttttttttttgagacgttgtcttgctctgtcatccaggctggaatgcaatggcaacatctcagattactgcaacctctgcctcccgggttcaagcaattctcatgcctcagcctcccgagtagctagaattacaggtgcatgcaactacacctggctaattttttgtgtttttagtagagacggggttttgccatgttggccaggctagtcttgaactcctgacttcaagtgatctacccgcctcggcctcccaaagtgctgggattacagccgtgagctcctgtacacagccagtacagtctcattttatacataagcaatttgtattttgaagtgttcatctccattttaacatggttttctaaaattgcctgaatttctaatgtgatagatatatacaggtattttgttattttactatgttatgaatttgcttttcagcatggaattacacaagcaaatgaacttgtaaacctaactgagttctttgtgaatcacatcctccctgatttaaaatcagctaatggtgagttgtgaaattcttgctttttttacagcttgccacactatacctgaattcaaaaaacagcttcctatccttgttcccttttgttctttttttttttttttttttcttttgagatggtgtcttactctgttacccaggctggagtgcagtggcacagtctctgctcactgcaactcctgcctcctgggttcaagcgattctcctgcctcagcttcccaagcagctgggactacaggcacgtaccaccatgcccggctaatttttgtatttttagtagagacggggtttccccatgttggccaggctggtctcaaactcctgacctcaggtgatccacctgcgtcggcctgccaaagtgctgggattgcaggcgtgagcctccatgccctgcctattatttcttttattgaataaaatctcaaatggtttccccagatcttgtccatgtgaaattaattattgataaagaaaatattgcttgattaggaggaaaataggaataaatacaactaaactgtaactcagctttgctacctagtgtataaataaggattatacattggcttccttttcttttttatttgaaagacgaattcttaaaaattggagtacatttcaaagtactagaaaattgataaatattaaggatatcttttggccgggtgcggtggctcacacctgtaatcccagcactttgggagactgaggcgggaggatcgtgaggtcaagagattgagaccagcctggtcaaaatggtgaaaccccgtctctactaagaatacaaaaactagccgggcgtggtggcgtgtgcctgtaatcccagctatttgggaggctgaggcaggagaatcgcttgaatccaggaggcaggggttgcagtgagccgagatcgtgccactgcactctagcctgggatacagagcgagactctgtctcaaaaaaaaaaattaaggatagtttctgatgtttatgaatgtattgatctagatccagatatattcctttttaaaaaaaatattttaatgtaggaaatttatgtacacccaaaggtgaagagaatattgtaatgagctcccatgtgaccatcatttagcttcaagaattattaacatttggtgatctattcctttcattaatttatttccctacccactagaataatgtaaagcaaattccagctagagagacatgtttctaattcagaatagcttcacttctgggaatgtaggtagacatgctcaccgatgcatggtccagctcatttttactcaattatgtaatatgtgttccttagtcatgaaacaggcatggggaaaaataaaatcatttataatcctaccaaaattaatgactaaatagtaaatcataatataattaactgtgctttaattacttgacattttatctttttttataactctgatgatgtcactaatttggaagtaatgatccttaccacttaagtaactgtggctttctgtttttttatatagtgaatgaatttcctgtccttaaagctgacggtatcaaatatattatgatttttagaaatcaagtaagtagctttttatttgttacacgccacttaatctctttaagagttttattatgtaccaccttctcatctactgtgcagtcattttatatccacatctaacaaaattaacaatgatttctttataacttagaattttagaccatgcttaattttcctcagatgtctttttgcaataatagtaatagaattgggatctagataatgtccacacattgcttacagttgattgtgtcttaagtctcttaatttacaatagagaggtccttctctgccactttttgtttgagatggagtctcattctgtcacccaagctggagtgcagtggcaccatcttggctcactgcaacctctacctcctgggttcacgtgattctcctgtctcagcctcccaaatagctaggattacaggcacctgccaccacacctagctaattttttgtattttcagtagatccggggtttccccatgttgaccaggctggtctcaaactcctgacctcaggtgatctgttcacctcggcctcccaaagtgctgggactacaggtgtgagccactgcacccaactgccttcctttccttttatttatttatttaaaaaaaatttttttttatttttttgagacggatctcactctgtcacccaggctggaatgcagtggcctgatctcagatcactgtaacctctgccttccgggttcaagtgattctcctgcctcggcctccctagtagctgggattacaggcatctgccaccacgcctggctgattttttgtatttttagtagtgatggggtttccccatgttggccaagctggtctcaaactcctgacctcaggtgatccaccagccttggcctcccaaagtgctgggattacagctgtgagccactgcacctggcctctaccctttcttatgcttgttgttggagaaaacactcatttatcttagagactttctcacattttacttttggctgattgcaccttgaatctctcagtattcaaggggtattggttccaggacgcctgaatatcccaaaattgatgaatacttaggtcccacatttgggcctgcggaatcctcatatatgaaaagccagccttccacatacagattttacatcccaggaatactgtgttttctatttgcatttggtctaaaacaaatccagccaggcatggtggcttgtgcctgtaatcccaacactttgagaggctgaggcaggcagatcatttgaggtcaggagttcaagaccaccttggccaacatgacgaaaccccatctctactaaaaatactagctgggtgtggtggcacatgcctataatcccatctactcgggaggctgagacatgagaatcacttgaacccaggaggcgaaggttgcagtgagccaagatcatgccattgcactccagcctggacaacagagcaagactcaaacccgtgttgttcaagggtctcctgaagtttatgttgtccctctagtccccatatttctatattggtaaatctgggggcttgattagacttagattccttggtcgggggtgacacaagaaagcatcataggtatactttctgtttcattttatcaggatatacacaatatctggttgttttgtttttttttattttttttgtttttttttttttgctcactgcaagctcagcctcctgggttcacgccattctcctgcctcagcgtcccaagtagctgggactacaggcgtcaggcaccatgcctggccctggttatcaatttttaatgatgttaagacagatcagtggattcagatgaaggagaacgttacattgtcaacattttttaaatagcattttaaaaattgagatatactttattcttttttttggagacggagtttcgctctcgttgcccaggcaatggaacgatctcggctcaccgcaacatgcgtctcccgagttcaagcgattttcttgcctcagcctcctgagtagctgggattacaagcatccaccaccacgcctggctaattttgtatttttagtagagacggggtttctccatgttggtcaggctggtctcgaaccccctacctcaggcgatccgcctgcctcggcctcccaaaatgctaggattacaggcatgagccaccgcgcccggccttattcatttatttttgagacaaagtcttacagtctgttggccagtctagagtgaactactacaatcatagctcaatgcagccttaaacttgtaggctcaagtgacccttttgcctaagcctccctgagtagccaagactataggtgtgtgccacaccacctggctaattttttatactttttacttagtttattgtttctttctttctccttcttttttttttttgagaggtagttttgctctgttgcccaggctggagtacagtggtgtgatctcggctcactgcagcctccacctcccaggttcaagtgattctcttgcctcagcctcctgagtagctgggattacacgtgcctgccaccatacccagctaatttttgtcttgttagaagagacagggtttcaccatgttggccagactggtctcaaactcctgacctcaggtgatccacccctgcctcggtctccgaaagtgctgggattataggcgtgagctaccacgcccggcccatttctttattttttgaaacagggtctcgttctgtcgcccaggctggagtgcagtgacatgaccacagctcactgcagccttgaactcctgggctcaagcagtcctcccactttcagcctcccgagtagctggaacccaggcacgtgccaccacacccagccatattgcattacttttaaaaaatcaattgagaaaaattatagagaatacctgcttccccagttagagtatgttggaattttgccaatcttaaatggtatctcattgcagttttaatttacgtttgttttattttgagttcagttaagcatctttccacttgaagggtccattttcatttcttttcggtgaactgtgaattcatcttcttttgcccatttttctatctgattattggtcttaatttttagagaacgtgtagtttttcttctgattctgaatgcctaggtcactttaattgtactgagaaaaaaatcaaaacttgcactcatcttatttctttgatgtctttgcccagtaacaatggtgccatcttgcaaaatattttaaacacacaagcaggaataaaacaatatgatgattactgaaataatcctcacaaatcttaaaactccaggccatatttatgtatacatacatatacaatggaggtattccaggtgctccctgcccagtcagtccctttctctctataggtaattactgtagtgaattcggtgtatttgacacccatggaagtgcttttcttacgctttcactacgcatttatgtttctgcaaaaattatttagtattatgtaggttttaattttttttttttagatggagtcttgctctgttgcccaggttcaagccatgctttttttatactttcactatgtgtttatgtttctgcagaaattatttagtatgctgtaggttttaatttttttttagatggagtcttgctctgttacccaggttcaagccattctcctgcctcagcctcccaagtagctgggactgcaggtgcccaccaccacgcccagcaattttttggtagagacagggttttgccatcttggccaggctggtcttgaactcctgacctcaggtgatccacccgccttggcctcccaaagtgctgggattacagtcgtgattcaccacgcctggcctaggttttaaatttttgtttgtataaatgacatcatactatgggtttcatttttctgttttttgttacttgtttgttttgagacggagtcttcgctctgtcgctcagtgcagtaacacaatcaagtcatgcagtggcacgatcttggctcactgcaagcttcacctcctgggttcatgccattctcctgcctcagcctcgcgatagctgggactacaggctaccgccaccatgcccggctaattttttttgtattttttagtagagacggggtttcactgtgttagccaggatggtctcgatctcctgacgttgtgatccgcccgccttggcctcccaaagtgctgggattacaggcatgagccaccgtgcctggccttttctgttttattttgagaatgaggtcttgctctgttgcccaggctggagtgcagtggtgcgatcatagcttacttcagccaggaaattctggactcaagcgatcctcctgccttagcctccctagttgatgggattacgggcatgctccaccgtacccacctacatcatgactgtttgtccttaacatctttttttttttcttttttcttttttttttctgagatggagtcttgctctgttgcccacgctggagtgcagtggtgcagtctcagctcactgcaacctccgcctcctgggttgaagccattcttctgcctcagcctcccgagtagctgggactacaggcgcatgccaccacgtctggctaattttttgtatttttagtagaggtttcaccatgttagccaggatggtcttgatctcatgacctcgtgatctacccacctcggcctcccaaagtgctgggattacaggcgtgagccgccactgcgcccggcctaacatcatttttgagttattcatttagtgcctaaagcgatccagctacctcagcctctcaagttgctgggactacaggaattcactaccatgcccagctaattttttatttaattttttcttaatagagatgaggtctcactatgttgcccaggctggtcttgagctcctgggcttaagcaattgttctaccttggcttcctgaagtattgggattatagacaggaatgaaccaccacacccaggaggcttttctagtttagactaatgaatgtttcaaatttagaggtttttaatgaagattgttctcgtatttgttgctttttgggggtgggaagagaacaaaaaatgagacacaaaaaggttaaataactttttcaagaaatatctgctagtgatgattcttaagtttggtgaaatcttagtctccttctctgtgatattattattttatggtatgttgatttatctgcaagatgttatcctcatagttttgtgctctgaaaaggagaatttagaaagtggaaattgaaccattatgtgcaagtgaaagttttggtttctgggcagcagcatctcctattataacagagcttaaaaatagcaaattgttctttaaatcaacaggtccttctcttccaattgtcttttactcaaatatggaatcattgcatttagagcatgtatattattgtgttttttaggtgccaaaagaacatcttttagtctcgattcctctcttgattaatcatcttcaagctgaaagtattgttgttcatacttacgcagctcatgctcttgaacggctctttactatgcgagggcctaacaatgccactctgtgagtattttattctaaagttttttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccactattcaacagtattatttcttgaaatgagctttgggtaagagatggaaaacagttctaggttctttccttcatcaagaacttgaagtacagatactctcagtggccaattaagggtagaaaggacatcctttgaggtgagtcaagccagtacctatcttcaggcccagaatttatgcagaaaacagttctgaatcttggctccacctccaaaaacaaaataaatgacagagtcccctgagattctgagttctttctcagtggtaatagatataaaccagggacaactgtttcaacttcagatgttgttgggtttagctggctttttggttcagttgtgtttggttctcgatgtgccttcttaggagcctaacatgagcacatgtaaaaaaattattttcctaaactgtctatcaattgtcagtggtgggagatggctcagttttatgctgagaagggtgacatagtggttgccaagggtaatctgcagtgacaagctcaagagttggtagtgactgaaagctgttttttcatctatagctttacagctgcagaaatcgcaccgtttgttgagattctgctaacaaaccttttcaaagctctcacacttcctggctcttcagaaaatgaatatattatgaaaggtaggctgtttccctggtgtgcagactacaggtatccaatctcagattgtaagggtgagcactctgagttatacttcaggttatacagtctatgaaccagataatgtttaccaagtagtaagttagtttagatatttcaaaatgaaaaacattatcttgtttactactaacaataatttttttttttttttttttttttttttgagatggagccttgctctgttgcccaggctgaagtgcagtggcttgatctcagctcactgccacctctccctcctgggttcaagcgattctcctgcctcagcctcccgagtaactgggattacaggtgcactccaccatgcccggttaatttttgtatttttagtagagacagggttttgccatattggccaggctggtctcaaactcctgacctcaaatatctgcccgcctcagcctcccaaagtgctgggattagaggccactgcacctggccaacagtaatcttaatttgatatggaacttctcattacagaaaatgtagcaaagcccttttttccttccctagattgagtttctttaaggcaaagaagagatcatgcaacgtttattaactgcatgctcacctaggtaggggtgaaatgtgggtgcctgtggtagactctgcacaaatcgtgtcttcttacgtactgccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgtatctgggtgtatgtttccaacactatccttcccccaacaatgatgtataattgtgtaattattgttgtttaatgtcctttttttttttttttttttttttgagatggagtttcactcttgttgcccaggctggagtgcaatggcacaatctcagctcactgcagcctcactctcctgggttcaagcgattcgcctgcctcagcctcccgagtagctaggattacaggcgtgtgctaccatgcccagctaattttgtatttttagtagagacagggtttctgcatgttggtcaggctggtcttgaactcccgacctcaggtgatccacccgcctcagcctcccaaagtgctgggattacaggtgtgagccactgcgcccagccttaatgtccatttctatgagagcggctaactagtctgtaatcttcattactgtgtttttagggtatgtaagaatacacagtatgtaataccttctctgtacggttgtatgagtgaatgaaataattctgcgccagcctagtggaggagcaccaatttatcctctagcccttttaacccaggtcagggaaggattttctctaggaagtgatctctaagctgagatatgacctaaccgaacgttaggtgtgagggataggtagcaatctgttgaagggtggatgagtctttgactccagtagaggaggaaacatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagacgtgcaccacatacctggctaattttgctatttttaatggagatgggttttgccatgttagccaggttggtctcagactctagcctcaagtgatccgccagcctcggcctcccaaagtgctggggttacaggtgtgagccaccaagcatggcctctgctactgatttctaagagaaagagaccccaaacagttctctctcagactcacctgctccattcatgtcagctcactgtttcttcctcttagtcaacctctttaattattttttaaaccttgagccttctagaaatactcagtatttcccagctaaattttgttgccaacccgtcctaattttaaaaggaagggaaatttagattatttttaaatgtagagagctatctcggggttgtctaagcatcttaaaatttagttgatgaattagtgcgcttttttccccccagtcgctctcttattctgaagtttaactaaactctatttgtttttgctgtttttgtattttacagctatcatgagaagtttttctctcctacaagaagccataatcccctacatccctactctcatcactcagcttacacagaagctattagctgttagtaaggtaatagagccaattttgaaagtggggttccttttttatttgctccaaactgtttgggcctcagaactctttggcattacgtgaagctttagagaaggtctgtgaattcttcctgaccagccactaatggacttttctgaaagtgtgggcatgctgttagattggagacgtaatagcagtcacctttaagtgtgtgctagaagcttgaatacattttcattctcattacaaaagtaacatgtttattgtagaaaaagaaagtgcagatgatccaaaattaccttaaatggagttaagtaggctttgcactaaatggatataaaagaggctgtctggacttctatgaaatgatgattaaaatcctttgtgttgtcttttcttccttactcttatttctcaaaaggaaagttcactctgatcaaaattttacagatacttagattcatgtttattaacactaaattttagaaaataaatccgtttaaggctgacagaattcctttttagatgctattcttgatcttatgagaattagatcaattcataggaagtgttggagggattttggagaacagagtgattattattcaactgagttagggctaagggtctttggactacttagggccttgagggatggagcggggagggaacccaagtctccgcctcccatatgtattaccatctcatgttctgattgagttagatttgtatgctagtagccttccaagaacttgtttaaagaaaaatggggttttgttgcttaaaaagaacataaaaaactactcatttgggggattatcagtaagtagacatagacattgaggcccacagaagttaaggctagtggcattactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaaggtaagttaacggaaattattttctttgtaatggaataaaattaacatggctataaaatgcagcccacctaagcgatgtgggccttttgtgtcagtcattccttctgaagctcacagctctgtttttacttttatcaacagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattgtgcgtcaggttttgatataactgtaattttataaagtagcttggagaaactggggatggcagatgtttgaaatttttttatttaaaataaatttaaggctgggggcagtggctcaagcccaccactttgggagcctctagtgggaggatcccttgagccgaggagtttaagaccagcctaggcaacgtggtgagatctatctctacaaaggaaaaaaaagctttttaattagttggacacagtggagcatgcctgtggtcccatctacttgggaggctaaggtgagagggtcgcttgagcccaggagtttaaggctgcagtgagccatgatctcaccattgcactccatcctgggcaacagagctagaccctgtctcttaaaaaaaataataataataataacggaaataattagtagaaaatgttatggtatgttttatcagaattctgtatcctttagttatttatatccatgatggaaaattttaaaaacagagccaaacaggttgattttaagaacttaactttggtcgggcgtggtggctcacacctgtaatctcagcactttgggaggccgaggtgggcagatcacctgaggtcaggagttcaagaccagcctggccaacatggcgaaaccccgtctctactaaaaataaaaattaggtgggtgtggtggcacgtgcctgtaatcccagctactcagaaggctgaggcaggagaatcgcttgaacctgggaagcagaggttgcagtgagccaagatcgccccattgcactctagcctgggcaacaagagtgaaactccgtctcaaagaaaaaaaaaattactttaatggctacgcgggaggaattgttccccatatgtttcagaaataattaaagagaaaaggatagattattacagtatgaactctgttttaagacatatatcatgtttaacttttcgaataattattcctgttaaccattttctgttggatctcatttcttaacagcctgggttactaggtgtctttcagaagctgattgcatccaaagcaaatgaccaccaaggtttttatcttctaaacagtataatagagcacatgcctccgtgagtatgactagaactttgtgcatttatttagaaattttgttaggtgctcagaaaagtcctaaatttatattgttgattttttttaattctttagtgaatcagttgaccaatataggaaacaaatcttcattctgctattccagagacttcagaattccaaaacaaccaagtttatcaagagtaagtaaaatcatctggatgttctacagaagtaatgaaagaaggtagctaaaacccttagactttatggttgcagatacattttttatccgttttaaactttatgcaaaaaatacttggccacgtgtggaggttcatgcctgtaatcgcagcactttgggtggccaagggaggccgatcgcttgagctcaggagttcaagaccagcctgggcaacatggcgaaaccctgtccctacgaaaagtacaacaaaattagccaggcatggtggcatgtgcctgtagtcgcagctgcttgggaggctgaagtaggagcatcacctaagtcccagaggttgaggctgcagtgagccaagattacacccactgcactccatcctaggtgacagagtgagaccctgtctcaaaaaaaaaaaagaaaatattgtaagggcctggtgcagtggctctcatctgtaatcccagcactttgggaggtgaaagtgggagtattccttgagtccaggagttaacgaccagcctgggcaacatggtaagaccctgtctctacaaaacagccaagcatggtggtgtgtgcctgtagccccagctactcaggaggctgaggtgggaggatcacttgaccctgggaagttaaggctgcgtgagctgtgatcacgctcctgcacccagcctaggtgatagagtgaaaccttctcacaagaaaaaagaaaatattttaagatgtttgtgttctccaaacattaagttagtgttagtcatattgtgttccagaggttggtttatggttggataccaaaacattttttcagtagagagaatattataaggaaatataaatcaaagagagacagcatgtaaaggtctatgacagaaagacaagttttctatttactagaaggcaggtattgatgccacagcctttggatgttaatgattaagcataggtttattttgcagacttatcagttaccagtttagtgcgtgagttctctatgctgatattctgcatcttctttcaacaggttttttagtctttattaatttgtattgcataaaatatggggcactagcactacaagaaatatttgatggtatacaaccaaagtaagtttgtttttattattttttaaaggaagaaaatgttttgactttttttttagtacaaatcagtatctctgtcttatagatgatgatgtggttcttggtatggagatagtgtctatggttttcaaaatattcttaggtattgggagtaaagaaaaagtaatcctggcccagcatggtggctcacgcccgtaatcccacactctgagaggctgaggagggcggatttagctcaggagtttgagaccagcctgggcaatatagtgagactccatctcaaaaaaagaaaaaacaccctggaatcattgttctaatcctctagattagaggaccatctactctacacactggcattctccacagccagtgttctatattatgttaaatggtcagtgttgtctccaggagcctgccttattaaaactaacagcagaaaacaccacatgttctcactcataggtgggaattgaacaatgagaacacttggacacagggcggggaacatcacactctggggcctgtcgtgggatggggggcaggggaagggagggcagagggagggatagcattagcagaaatacctaatgtaaatgacgagttaatgggtgcagtaaaccaacttggcacatgtatacatatgtaacaaacctgcacgttgtgcacatgtaccctagaacttaaagtataattaaaaaaaaaaaccagaattttccttcccccttttttaaaaaatcgtgctaatccatatcgttccaattttagtatatgtgctgctaatgcaaacacagcagaatttttcaaatgagaaatacttaggaccaataaattaactttgtttttgacttatctggtatatatgcaaagaatgtatttaggtggcatttcccattagtagggaataaaacaattataacgataagataaagaacaactcttagggaaaatttcttcggggacagttagatccctgtacctcagttatgtctcaaaaattctacattgactaaaaaatgaattactctggaaaggagaccagaaaacatggcttccggcagtaggggattttgaggaaatctcatgcactgctagtgggagcctgaattagcctgatctttctagagagcaaaatgtatgcactttttatccagagcattagaattgccataccctttgagccatatttccacttcaaagaattggttctattaacgcataaactgaggattttgcatcatttagaattacggaaaacttcacttctagcatgtttgcaacaacatagaatgattggccgaattattttaaatagccattagcatttatgtacctgcaggtatgtaagcaaagacagttgggaagcttataacccaaaaatgttaaaactagttgtttctgggtggtgggatgattccttttttccctccttgctcctctctcttttttttttttttttcttttttttttttgagactggccaggtgtaatttttaaagaaaaaagcagagagggccaggaatggtggctcacgcctgtaatcctagcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttccactccagcctgggcaacaagagcgaaactccgtctcaaaaaaaaaaagaaaagaaaaagattatggcatttggctacagggtagaggtgtgatggggtttttttatgttttgactttcagtctcttcagatgatcaaaaacagcagtcttgttatttagtaatttatcatattcataagaagtaactaacatctaagcattttactatttcattatagtgataatctaatattaagttgatttattttgctttaatagaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggtaagtacttcattttaatatttttgtaagttacagcttccttcccatatgactgcaaaattaacaaagcttattctcttgggggccaagagaatcttggtctgatctcagcttctccacaatcagatccaagacatgatttctggatccttctgggcttagaatgatcttgtttcctgcttctttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtgggcgtaataaaactaaatctcattgagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaagtgatcctactgcctgtcagccttccaagtagctaggacccactatgcccagctaattttttatttttttgtggagacagggtctccctatgttgttcaggttggtctcaacctcctgggctcaagccatcctcctccctcagcctcccaaagtgctgggattacaagtgtgagcctggacacagttatttttttttaattgcagcatactcagaaattaatagatcatggcataaacctaataatgactgtatagttgcattttgtcagcacttattatagagttcttacatgttacctgataaaatatatatttttcaagccagacacagtggtttatgcctgtagttctagtgctttgggaggccagggctgcagtgagctattacagtgccactgcaatccagcctgggcaacagagcgaggtcccgtttcttaaaaaacatatatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgctgttccctggagagtggaggttacttggaacttttcaaaccctgacaccttagaaccgtgaagtccagtccagtggtggatccggccggatgcctggtgagcttggttgcactggctccctcccttggcctggcccatggaattgtacagcattcgtttctgaggaatgaagaatcagaatatctaaattttgtgaggcacagtttatgctggaattgttcattgtccattcagtgtagttaaactggaacttttgtcttcccagctcaagtgatttgtcacaggagttatcgatatcccttttttttttcttttttacccccaagataagagtcttgttctgttgaccaggctggagtgcagtggcacaatctcagttcactgcaacctccacttcctgggtttgagcaattctcctgcctcagcctctcgagtagctgggattacaggcgtccgccaccacgcccagctaatttttgtatttttattagagatggggtttcaccatatttgtcaggctggtctcgaactcctgacctcatgatctgcctgcctcggcctcccaaagtgctgggattacacgcgtgagccactgtgcctggtgataacttttttaatcttaggcacttgactcgaatggtttttcttattttgaatttttttttttttttttttttttttttttgagacggagtctcactcttgcccaggctggagtgcagtggcacaatctcagctgactgcaacctccgcctcccaggttcaagcgattctcctgcctcagcctcctgagtagctgggatacaggcatgcatcaccatgcctggctattttttgtatttttagtagagacagggtttcaccatgttggccaggctggtttcaaactcctgaccttgtgatccgcctgcctcggcttaccaaagtgctgggattagaggcttgagccactgtgcccagccacttgtttctgtaatgttgcatgagaaatttcaagttctcttaagtctatttgtaccatctagtcatttaagggctttttgttgttgttgttgttgttgttgttgttgttgttgttgttggttttgacacagtaatgggaatactacattttacgttattactttggcttaagtggtcgttggtagaaagatactgaaatattactgaagccatttttaagccacaatttatttggaaagtctgggacaacagggaattgctagtgatggtttctgtatgtttttcactcacatgagctccttaagtatttatttggctttgctcttcctgaagctgcttgtgaacagtcagtcagataccgttctggaggctgcttgattcaacatcttaaactcagatcgagttcgaaacgttttccttcttcagttcaaaaggctgagtagtagatggtgtgccttttaaaatagttactgaacagcaagactagtacatttacttactttagcacagttcattaattatcaaataatttttttaaatgccttctattgaagttgcttattcaatcgtccaagacagtttttatatctggctttaaagattttaggacatggtggacagaaactgctggagtggtttttttcttttttcttcacaagccttactgactgtagctcagtggtgatgcacactgtgggtatgaagatcagggtttgagttacagcactgctactgactatgaccttgagcaaatgagttgacctctatgccttttttttctcttctgaaaaatgagcatattatttaccttcaaggtggttgtaagaataaaatgagatgatgcatgtagagtactcaagcagagaacctgtgcagagtaagcacacatcaggaaaagctgctgggggagcagagggcttgggtgggaggaagcgtttgttactgagcacacttaccaatgtgctgcatacctggaaggcgggaaggctttgtggagaagagtcctggcatgggcggccccacctgtaccccagggtgtttttacagaagggaagtattgccaggtttctcatcagagcttcctgctaggtgcattcattctccatggtattcaatcatgtcttttaacaagctgatttttaaataattgagtttttaaattatttttatgtatttatttttttgagatggagtcttgctcagcccaggctgaagtgcagaggcgtgatctcggctcactgcaacctccacctcctggtttcaagtgattccccagcctcagcctcccgagtagctggaattacaggcacgcgccaccacgcccagctaacttttgtatttttagtagagacagggtttcaccatgttttgtcaggctggtctcaaactcctgacctcaagtgatccacctgcctcggcctcccaaagtgctgggagtacaggtgtgagccaccacatctggccaccgactttttattttaaatgtattttctttgtgggaaacttggaaaataaagaaaaaatatttaaaaattaaaaataattcatattcctacctacattaagcattttggttcatttgagatcattctgtatatagttttgtaatttttttaaaccatatttacttggtaaacattcagtggatatatgtgatttatcattaggatatatcattaccagattatgtaattgtagtcattgctggatgtcttggaggttttctgattttgtagacaactcttgagatgaacatctttatgcatcaatttttagttcctgaaggtggaattagagccaattttcttgtgcaaagttcatgtcagtttctttaacacacctttacctacactgggcattatttggttgccattttgataagtaaaaatggtacttttccttacttctgaggcataatcagattggcatttaatcaaactattacatacatgtggtagaattcattttttttaaatttaactttgttgttgttgagagggagtcttgctctgccgcccaggctggagtacagtggtgcaatctcagctcactgcaacctctgcctcctggtttcaagcaattctcctgcctcagcctcctgagtagctgggattacaggcaccttccaccatgcttggctaatttttgtatttttagtagagacagtttcaccatgttggccacgttggtatagtggtgagcatagctgctttccaatttactttatttatttatttatttatttatttatttatttatttatttatttgagacggagtctaactctcctacccaggctgtagtgcattggcacgatctcagctcactgcaacctccatctcccaggttcaagcaattctcctgtctcagcctcccaagtagctgggactacaggtgcacaccaccatgccgagctaattttttgtattttttagtagagacgggggtttcaccatgttggccaggctggtctcgaactcctggcctcaagtgaactgcctacctgggtctcacaaagtgctgggattactggcttgagctaccacacatggcctcaactcttcattattaaattggttttgtgttaggtgattttgcccagctgtaggtgaatgtaagcgttctgagcatgtttgaagtaggctagactgagctaggatggtgggtcggttaagtgtattaaaatgcattttaacttatgatattttcagtttatggtgagtttatcaggatgtgaccccatcgtaagttgaggagcatctgtaatagcattttgttttttaaaaatatttaatcatctttgtcaatgtctcttgaatcctcagcgttgacaacgaagatgtgtccctaccctctgcctctcaggcttgctaattgctgggttctgctttcactttcacattgttgaaggagatatttccagttgttttctgtgcattatctgtagttcccttttaaaaggtgaagctgataaacacttgttatgacagtgtgaactgggcttaatgctgtgtcaagcagtgtgcaaagattacatttccctctcctcatgtcttgacttctgcatccctcaagagagaatgaatgttcgtaaggttaaggtcaaatggaatggagtttgctcctcatatttcatcagttgctcaaaggtactccccattttagcttgtgttctgtttggatcctgactttctcatggtggtttttctggacttttattagctttctttttcatcctgggtattacatggcgtgccttccactctgcccctggatttctttttacagccctggctcttgtgggccacaacagttcttgaggtaggctgctagggttccccattggagcctctccattccagtgttccagggggcagatgagctcctatccccactggcctgtcttgctggtgttcagggccctggcttccactttgcgaggtcacctttcaggattcatgtgtatccactttgctgtgtcagaaactccctactgctgacctccctctcctctttgctgtcattaatggattctcattgtgggagataaacgtgtgctcagcctagaataccacatgattttttttttcttgattcattgcttttgcctgttagccttgttgttctaaagtagttcatttttctactctacttttcctttcccctcaatgacccccaccccaaaactgtgcctaaatactattcatgcagtctttgagaatcaaacaggttcacactcttattcctgagtacagaaacttaccgaatcacacagctggataaagccgggattgaaaccctggcagtctggtttccagagcattctggcttagccacttatgccatggtttggcaaaagttagaaacagctaatcagctaataagggcatgatcacaaggcattttgctaataagtttttaaaatatacactatgggtgttttttggttgtgacaattcttgggtccctattcataggagcatcccccgcaccaatccctaggcacaatcctgtatccagcctgctggacatgaccgtttattccatttcgtaaaccctaagcatttgctctgcaaacctcctcctgcttggtccttgctcttactccttgtctgagaaacatggtggctgagctttgtgactgcaaggcagggctcatccttagggtctaccctgaggtattcttagtaggactgctctttgatagggcaaaggagtttcatggaccctttgaaaataatttagaggcattttcctttggtttctctgaatgagctaagaacccctgataataaggaactgctgtgggctgatggtcagttcctccagcccctccattctaggaaggtgtctggtaaagcagctcactgtgtggttggggaagggagacaaactatgaagttgtgccgatttctgggttttttcccttacacatgggatggtgtgagataaaaatctggcaacatagacgcagtgttcatgtcaagaaagagccacaataggtaagtcccaagactgttttctcagacctcatggaaaaggagacctcttggagaagtgagaagcaaaacgagaacaggtttattcaccttggactggaaagataacgccttgtaagcagttagaggcaacgcttttggatccagaggggaaaaggatcgctgctcccagcaacctgtgcttctgcagcaaatagcagagaagacagatcccgagtccctcttaagtgggtccagcagggcacggggaggagaagcttggcactcgccaggtcctccccatccaagacagaggaagtcttggtgtcctggaaaggccaggcaacccctgccacaggtttgatgtccaggtggaggcagccccacacaaagagcctcctctgccatgtttatcgatctcaggcgggaaccagggaagacgtctctaaagtggtgcctgcacagcatcctggccagtcaggaggaagcagcaacctaagccaactgccacaggttggcccttccaaaccccagccatgggaacacctggccctccccactgtgcttaggaactgagtgcttaggaaactaaaggatggatttggccacgggatgggccagaggtgctccagagccagctgaggcacatcaggccaaagtcaccctgcacttcccctgaggcagcagttcccaccaggattcacaagatttggagtgctgtcagaggaaccgcagtcatttatggctgtatattttgtactagaaaaaagtcactaggaattcatgggtgatattgcttaggacagtggttcttaaagtaccgtcaacatcacttagcacctaagtgcttagtagaaactacttcatcaaaaactctgggaatgagacccagcaaccttttaacaacccatccaggtgatgggatgcatgttcaatttggtgagccatgacttaggataaagctaagtaaaagtaagtaagacatagacggtagcaaaaattgtgaagatcaggtttgagaacagtggtctaaagcttcatgaccacaaaaattggaagggaccacattttaaagatgtgaaattaacagctttacttttgtgcaagaggtggcagaaaaaagatgagctgtggtaattagggcccatggggctgagcatcatcaccccgggagctatgggcctcgctgggccaaaaataatgtggcccctgggctgcagaagttctgagcatttccagttttcttagctgaagtttgattcagccttgaacggtgtttacattgtacttgttcataaatccaaggaaccaggaaagaaacttactaagactcagaattttcaggcacacattacaaagttgccagcacattttcagccacccaccaggtgcacatacactctgcgtacagaacagacaccagtcagaggtttgcacagcaaaagggccaagcgacttccaaactacagagaatctcaggccatctgccttgggaggtcttttggcagccataacaaatagactcaaaaaggcaactactacaaagaacagagtctgaagaagtgacgcacaggatgctgacagacccttagtagagatccttattccaaaggggcatcagctgcctgctaatccatccagggtcaggaggagattcctagtgaggccgctactgcagtctaaggagtgggaacaatcactagccagactggagcagcccagctctgaagaggaggggctgtcacctgatcctgcctgtgccccatcaagctctggagaccaagcaaaatcaaagctccaggcacacctcaaagctcgcttgacaactgaaagagccattgtgtgtgcactgtaggtaaggtcgtggtagagctgcctgggaaagggtggaagacacactaagatttatgattggatacagggcttgtgggcaacttccaaatttttcataatctacttttaaattaaaaaaccatcttaggccaggcatggtgacccatgcctcccagcactctgggagccaaaagtgggaggattgcttgacctcaagtttgagaccagcctgggtacacagtgagaccacatctctacaaaaaaaatttttgtaattagctgggcataatggcacatacctgtagtcccagctattcagtaggctgaggcaggaagatcagcctgagcctgggaagtcaaggctgcagtcagccatgatcacactggtctgagcctgggtgacagggggaccctgtctccaaaaaaccccaaacaaaaaataattttaaaaattactggctgggcatggtggctcacacctataatcccgcactttgggaggccaaggcaggtgggttacctgaggccaggagttcgagaccagtctggccaacatggtgcaaccctgtctctactaaaaatacaaaatgagcctggtgtgagggcacgcacctgtaatcacagctactcaggatgaggcaagagaatcacttgaacctgggaggtggaggttgtagtgagctgagattgtgccattgcactccagcctgggggacaagactgaaactcggtctcaaaaagcaaaacaaaattgctactatacatagactgctttactgttgtcattgcagacctgatgtttgtaggtttcagtgaatgtaaaagaatgtgtggatgaacggttttgttgttgtttttgagacagagtttcgctcttgtcacccaggctggagtgccatggtgcagtctcggttcgctgcaacctcagcctccccagtagctgggattacaggtgcccaccaccacgcccggctaatttttagtagagacggggttccatcatgttggccaggctggtggtcttgaactcctgactgcagctgagccactttacccggccagatgaatgcattttttaaatattaaacttaggttagaagcacataataaagctgtacacatctcctacagttttcactaatgaaaattgggatgccatttaaattacaaagaagtctgaggagaatgtcctacagactagtttcacatgcacatgctgtccttacatgctttgtatacagacattaaacacatcagtacagtacacaaagtaacaagttccacgaactcagcaccacaggaaaggtttacaaaaaatccaagaagatggctatgctgcccattaacaaactcccacctcctatctttgagttagccattgcttcttaaaacaatgtatctctttaaaagccctatttaagaacattggccaactcctccactcttccctctgctaatcctgctctgattaagtgcttgacaaatccagtatttattgatttggaatttcaagtaagttttttgtttttaagagcacacaggcatttaagcccttaaaccagaagtagtgataaatactgctgctttttattgaggctgagtctccaacacctaggctatagttgcagtagcgtgatctcagctcactgcagccttgacctcgggctcaagtgattcttccacatcagcctcccaagtagctaggactacaagcccatggtaccaccatggtgccatgccgggctagttttctgttttttttttgttttgtagagatgggggtctctatgttgctcaggctggtttcaaactcccgggctcaagcagtccactcaccgtggcttcccaaaaggctgggaatacagggatgagccaccatgcccagccagtggatgcttctgacatgttatgtgcaaacaaagccagacctctcgggcctcaggtttgcttcctgggatgatcctattctactgaactcacactgatccctataaagcaagcagcaacatcacgcttttgggaaaggccaatatgttttcctgtcgatcataccaatcccaggcgccctcctaacaggagggatccagactatggtgtccatcactgagcattcacccaacaaagccacttaaaaaaacagctcagtaaactagattcagaagtgatacttgtttgtaagacctatccacattactctggcttaagaaggcctgaaaacccagaaaaacacccagctatgggtgaaaatacttacaggtgaatgttttagtctaggattagcattaagatacttcaggaaaaaaataatggggaggatgagacaagaacaacaaactcaagacagctatgaggaaataaccattacccgttaagttttccctttaatgaccatgaggacaaagtcatgacaatgcagtcaccacccactttttgaaaaaaaaaaacaatgccaatgtgggaaccgactgagtcccaagcttatctactgtaggatccaagagagagacaatctcagtgttggagaatgcactgagaacatagaggagaaggctacaaagaacactgagtatacaaatgcatacagatagatgtgtatagatatatatacacatagatttcctgtccgctacagaggtctagaaacaataacaccccagtagcagtaagccctcagagcattcagatcttggtttctaaatgctgtcttctagtagagggaaccagggctccttaggaaaatggctgaatcaggctaggcgtggtgggtcacgcctgtaatctcagcactttggggggctgaggcgggcggatcataaggtgagaagttcaagaccagcctggccaatatggtgaaaccccatctctactaaacataaatacaaaaattagccagatgtggtgtgcacacctgtagtcccagctacttgggaggctgaggcaggagaatcgcttgaacccacgaggcggaggttgcagtgagctgagatggtgccactgcactccagcctgggcgacagagtgagactccatctcagaaaaaaaaaaaaaaaaggctgaatcaggactaggggaaggaaaagaacaagatgaaccccaaatatctcaatgtgtcaagttagtcttcaaaaaatgatggggacaaatgacagtttttgtggacatagaaaagcccatcctaaaatttataaggaatcctaagggaccctgaataaccaaaaacaatcttgaaaacttagctgaaggactcataggttaagatttcaaaatttactacagtaatcaaatcagtgtggtaccagcacaacaacagacatataggaggctggttgcggtggttcacgcctgtaatcccagcactttggaggctgaggtgggaggatcacttgagcccaggagttcaagaccagcctgagcaacttggtaaaaccttgtctctacaaaaaaaaaaagaaaaaatcagccaggcatggtgacatggtgacacacgcctatagtcccagctacctggtaggctgtgagccaagactgcaccactgcactccagtctgggcaacagagtaagaccctgtctcaaaaaaaaaaaaaggccaggcgcggtggctcacgcctgtaatcccagcactttgggagaccgaggcgggtggatcatgaggtcaggagatcgagaccatcctggctaacaaggtgaaaccccgtctctactaaaaatacaaaaaattagccgggcgcggtggcgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaatatatatatatatatatacacacacacacacacacacacacacacacacacacacacacacacaccccccccccccccaaaggaagagaatccagaagtccttccatgtaatttttgacaagggtgccaagaccattcaatgggggagggacagtcttttcacaaatactgttgggaaaacagtgtgcacttgccaaggaatgaagctggacccttacctaacaccatacacaaaattagcttaaaatggatgaaagacctaaatctaagactaaaactaaaacatgaggcaaatccgcaaatcttcatgagttggacttagcaatgttttcttaagtatgacaccagaaacaggcaacaaaagaaagtaatagacaaactagacttcatcaaaattaaaaccttttttgcatcaaaagcttttctgcaaaaagcttttgcagaatgaaaaaacaactcacagaatgggaagaaaaaaactgcaagtcacatctgttaagggattaatatccagaatacacacaatactcctaaaattcaacaacaagcaacatgattcaaaaaaaatgggcaagacttggacagacatttatccaaagaagatagacaaatggccaataaatacgaaaagatgttcaacatcgttagggaaatgcaaaccaaaacccccatgagataccacctcatatccactaggacagctactatttaacgaaacaataaacattggcgacaatgtggagaaactggaaccatcatgcactgttggaaagtgatggctgcagtgggaaactggcagttcctcaatatgttaaaaataataggtcagacgcagtggctcacgcctgtaatcccaacactttgggaggccaaggcgggcagatcacttgaggtccggagttcaagaccagcctggccaacatggtaaacccccgtctctactaaaaatacaaaaattagccaggtgtagtggtgggcccccgtaatcccaggtactcgggaggctgaggcaggagaatcacttgaccctgggaggcagaggttgcagtgaaccgagatcgtgccactgactccagcctgggcagcaaagggagactccatctcaaaaaaaaaaaaaattatatgcagcaattccacttctgggtacataccccaaagagttgaaagcagggtctcaaagattttgtataccaatattcacatgtggaagcaacccaagtgcttttttttttttagactgagtctcactctattgcccaagctggagtacagtggcacagtctcagctcactacaacctccacctcctgggttcaagtgattctcctgcctcagcctcccgagtagctgggactacaggtgcgcgccaccatgcccagctaatttgcatatttttagtagctatggggtttcactatgttgaccaggctggtcttgaactcctgatctcagggaatccacctgcctcggcctcccaaagtgctgggattacaggtgtcagtcaccgtgtccaaccccaagtgcctactgacaatgtattgataagcaaaatgtggaatatatacacacaatggaatattactcagccttaacaaaggagggaaattgacatattacaacacggataaaccttaaggacattaggctatgtaagataaaccagccacagaagggcagatactgtccatttataggaggttcctagagtgaaaatcataaacaagtggtggtttccaggggctggaaggagcatgcgaggggagttagtgtttcatgggaacagtttaagttttacaaaatgaaaagttatggagttggattgtggtggctacacattatgaataaactgtacacttaaaagtagttagcagtctgggcaacatagcaagacctcgactgtacaaaaaaaaattagctgggcatggatgtgcacacctgtagtctcagctattcgggaggctgaggtaggaggaaagcccaggagagcaaggttgcagtgagccaggatcacactgctgcactccagcctggatgacagattgggatgctgttttaaaaaaaaaaaaaaaaaagtggttaataggatggtaaattttctatgtgtcttaccacaattttttacaattttaagatggaaacatgccaaaaggacacaagagtcaccttgacaggtcttctgatgtccaaatttgaagtaatttgaacatcaaataaatggttgcaatggattgcgacccagactaggagtccattagctgacacactgcatcaatggggagggaaggcgcctccatgcaggggcagggtgtcggcagaaggaacattggacatggaagctcatggatgggcagtggtggtggattcacatggaagttgtaagtgaaggacaaggatggagggtagaggtctgaagaggaacaggctggtcatgtgctttgaggatgcctccccacaaaatactccttgattaccaagagacatagtgtgacctgactgacagtggagcaatctgcctgggtcaccaaggttaacaaactgtatgcccctggagtgacatacagagaagagcgcagcatttctgtggctttcctgccacaaaagtgctgcctaggtctggtcaccatcatccagacccaggctgagggtgtactacagagaggtctgcgggcttcaccccactaggacgtgaaacacagatgccgagaggactgatgcagacagcaggagaaaactaaaggcaacacacacctcttgacagggaccctggaccaggaaaggacaagacactgttgggacagctggcgagatctgcatggggtccatggactggatgcagtgttcactccctgacttgggggaatatctaaattttgaagagagagggagaccaggggagacaatgtacacataatttcagtaaaatgtaccttttatctgtgaaattattttaaaataaaattttaaaagttaaaggactaggtgcagtgactcacacctgcaatcccagcactttgggaggatgagatgacaggatcacttgaacccagttggactggcctgggcaatgtagtgagaccctctctcttaaaaaaaaaaaaaaatcattagccaggaatggtgtcatgtgcctgtagtcccagctactcaggaaactgaggtgggagaatcacctgagcccagtcaaggctgcagtgagctgtgatcatgccactacactccagtgtgggtgacagagcaggacactgtctttaaaaaaaaaagtagtaaagaaaggctatatactgctgggtgcagtggctcacacctgtaatcccaacactctgggaagtcaaggcaggaggatcgcttgaggccactgcaacccagcctgggtaacagagcaagctactgtctcaaaaaggaaaaaaaaagctatattgtaatgtcttactatgcaaagctactcatgaaaaacttaagccaggcgcagtggctcacacctgtaatcccagcactttgggaggccgaggtggccagatcacttgaggtcagttcgagaccagcctggccaacatggtgaaatcccatctctactaaaaatacaaaaattggccaagcgcactggcacgtgcctatgatcccagctactcaggagggaggctgagacaagagaattgcctgaacccgggaagaggaggttgcagtgattccagattgcaccactgcactccagcctgggtgacagagccagactccatctcaaaaaaataaaaataaaaagaagaaaaacttactactgtttttgaactataattttttattgtaatatttttaacacttaatgcttacttgagtgtattaccaaagttaccccagggcaccccttcttcaatgaagtacccagaatgagttttttttttttttttgagacggagtctcgctctgtcgcccaggctggagtgcagtggcgcgatctctgctcacggcaagctccgcctcccgggttcacaccattctcctgcctcagcctcccgagtagctgggactacaggcacctgccaccatgcccggctaatttttttgtatttttagtagaggtggggtttcaccgtgttagccaggatggtctcgatctcctgacctcatgatccacctgcctcggccccccaaagtgctgggattacaggtgtgagccactgcgcccggcccagaatgaatttttataaatagtcgaagacacaaaagatcacactggtcggcttccagtgttgccgccagcaagtacgctccctgcgaaagtgcatcaagtcagggccccaggctcagcttctctaagaaccttcagtctgggggagggttgtgatgtgagtcacaggtccatgaattctttttttgttgtttttaaagacgtaaagacactttttctcctttcactgcttttctcctcaaaatgttgcatttccttctgcccttagtgttttccataaccttctgatcactttcagttattccggcagtacaatcataggctggctttacagtgaagcctttataatcttcttccacttcttctaaaattaaaaaatgaaaaccaactagcccaaccctcaaccaggctggaacgcatgtcctcctcagtgctcagttatggtgagagatgaggatgccctgggaagtgtccggcagtctcctctcagctccttggggtcatttctttgggtagcaatgtcaggtctggacggggcacaagtccctacatccaggtacccaacatgcctctgaggcagcaacgcttcccagaggggctggccctggtccccccacgacgagcttccatccccttactcacatcttcccttattttagttactgctcaacaggaccaaacacttcattagtagctgtttattgatcaatggtttgatataaagttatttcagatcttcagacttttgcccagatggaatcacaagcattacaaagtttttttcttaaaaataaaaaaaggataggggcaagttgggaggggaccaacctagcagtagtggcatttgagaataaattaacaaaaaaatttagtattaccatttattgatgacaaacacttaagttttacttacattccatggggagaaaaattccagcgtaaacaatgaatggaagcagtacttaactcgcagggctaccaggctttccatacggaccacacgcagagcctcagtgcacacacttctgtgtacagtaacacaacatcaaaagcaacacagctgtatacagaaacgtaggtcattcttttcagccctaatggagatgtaattaacagtatcgagcactctggaaaatcactctgcaggtttatatggactacatggagatcatatcctgtagtgtagtgaaagctaagtcctcaagagccatatgtatagatacacaatgttttttaataatctttaaaacagagatcaaagttcatttaagtcctgtttgcattaacaaaaataaaaatgaaataaaaatggaaccaaatgatcatctaaagtttaaaattcctaaattgtccaatttatacaactgtgggagacttattcaaggtttttgaaagtccaggactgtttcagctgaaccagagggcacacaatttgcatcactgaaactgtcctgggttagtcaatgaaataaaaatgtctaaccacatacacatggatatgatctttgtcggttagattattgataaagtcagtctcagacaagtttccaaactgtgctatttaactagatacaattgagaaattctcaaatgaaaattttatatagtgtcatatcaatcaaaagaaaataatgaaactaagaatacagatcactgttggaagagaaagcagtggtgatggtgtgggtactgcaggaggtggtggggccgtggcacactagaaaagttgggtcacgctgagtaggaagcatttgattttctctggtgcttttagctctggggccggtcaaaggcctctctctggcatggctgtccagggtttgtcccaatgtgtctgagtgagccagcttgagaaggggtcgtgccgtttcttctttcacacaggggaaaaaaaagaccaaacacggaggtgcccagggtgtggatctgctggtgtcccgggagaaccagctggctgggcagcccttcttccccacaggcagctgctattgcgtagggaccgccaggtcaccgagtggccatcacaacaaaccccagcacagtccagcccggccacagccgcctccttgtgtttctgttgtcttccctgctgctgcccacatcctttacccaccgtgtctctcggcccactggaggtatcagaaattccaaattttcaaagcagtttcagtattttcagtatatatgttgggattttataatggttcatggccagaaaaggttcagcacctcccacacctttaaggaagaaaaatgaaaatgacactagttttgaaatgtaagagaattaaagtactgttaaaaatgaaaagaaattggcaaacatcaggaagtacaatactaaaagccccagtttatgataacaaaagttttcccagggtatgccagtaagtaaaatacgcaaggagagtgtgtgtacttatctctgtggggggaaaggaagaaaatgagggaagaaatatatgtctatatttgtataaagaaacatacaggaaagatacaggagaaactagtaaaaatgtgatctatgggggaggcggtggggagaataggagggatgggatgggggctgtccgaggggaagattgtaccttgtaaaataatgcagagttctgaccatgtgaaggtatgaccaactcaaaaaggtttttttgtttttttttgggacggagtcttgctctgtcgcccaggctggagtgcagtggcgctatgtcggctcactgcaacctccgcctcccaggttttaagcagttctctgcctcggcctcccaagtagctgggattacaggtgcctgccaccacacctggctaatttttgtatttttagtagagacagggtttcaccatcttggccaggctggtcttaaacacctgacacctcatgatccacctgccttggccacccaaagtgctgggattacaggtgtgagccgctgttcccagcctcaaaatgtcttttaaaagtagagctttctgcccagagaatctggaaaactttcaggcaaaagggccagaaagtaactcaggcaaatatttccccgctgagtcagcagatagtgtaaactcaacacaaacgaggggcagcctccccatcatcagcgccttccccttcatcagtgcactcacacagacattggtccgtttcctgttcttggcatctctgtactttgttggtccaactcagacagcaactttaagatgttcagcgcagcctagtggggatggaaagaagggtaaagccacagccaccgcttgggaccacagcataatacactggtcaggcaggcaagagagttcctgctgcccagcaaacaggtggcaacttcttcaactctggtactactaaataaaactttgaatttttaatttaaaatacaaattaaaaaatattcagttacctcactgaatcataacctctgaaaatgttatatttttccttctagtatttttaaccatgtggtaaccagactgtataaatgttatatcctgctttctaacaaaaatctatcatgtatttttctttctatagagacagggtctcactaagttgcccaggctggtctcaaactcctaggctcaagcgatccttccaccttggcctcccaaagtgctggaattacaggtgtgagcctccacacccggcctatcatgtatttttcttcttattacattatcttcggagacactgttttgttttgaaacgcagtctcacccagctgcccaggctggagtgcagtagtgcaatcttggctcactgcaacctccacctcccgggttcaagcgattctcctgccttggcctcccaagtagctgggattacaggcacccaccaccacacctggctaatttttttttgtatttttagtagagatggggtttcaccacgttggccaggctggtcttgaactcctgagctcaggtgatccgcctgcctcagcctcccgcagtgctgggattagtgtgagccaccacaccccacccagagacattaatttcatgcatgcatgacatcccatcaagtgaatacatcacagtttacttagatttgttgatctgatcaattccttttctcagttttcttataacaataatttcatctgaacagaagaccaaagcaagtggtttttacagctgccagaacgtggacctgcaattccttgttctggtgagagatgaagtgagtgcagtctctgggtgagctgcaggatcccagttgcccctccaggccagcagggaaaaggaagggaaaggtgggctaaagctgatgagttctgatcaagagtgagaaatcgatccaatcagctatgacaaaaagtcttcaaaaatatgaacactatcaaacgattcattgctctcaaggtctatgggacaatctttctcccatcttcctcaggctagtaacaagctgaaccaaggcaggctccacataaacacacaacaccccaatccctcacccaaggtgtgacgtaccatatcatggcaggactccacatccttgccgataccatggctgatcagaggtggctgagaggagcaattgataagagatacaaattcgttcttgttgtttttggggaagtctttgtattcaacctaagggggaaaagagagctgaggctaggtagggaacagcaagtatgagtgggctggagggctgcagctccaggccccacaagcaagatcaccagctcttttttccaactcagccccactgtggccatactaacacctgccctgtcagcccagaaccttccaggaacctaggtgtctgctcagaagcccaagactgggagaagccatatcctttcctaccagacagaaagtgtcagcacgatgagtctgttctttgaaatccaaatttacaaccactgctagtggttagaagcttttagggttggcttgcatgttgaaatcttactaccaaaggataaagatatttctcttaccacatatgcttacaatacttctatacctcctacccttccatcactgctccccagcccatccctggacagaacttgatttaagaaaaaagtacaaagttcaaagttcattttctgagagaagccaaaagatgactgtcctgaggcacagccatcacagctcaggccagacagttacctggaatccctggactctggaaagatagtccagttgctcagagggtctcgtgagaggtccatggggtacgtggcctgaagagatgttattctttaaaatggtctcggctgtgggcgaggtgcccccatacaacaactctcgggctatcatggcagttaccgtggccttggcaggattcggagctgccctggtaaaatctttggtgtgatgtccttgactaactcctacagcctgggcgacctcgggcaccatgggaagaattccagcaggcagctgctgatgacttagataaggcatcctgaactcatcctctttattacctgggagggacatacacggtaaacacgaatccacatccacagcctggaaaaacgcaatgacaccatcaaaccccacgctggccctccccttggcacgcatggcagcgcagggaatcagggaatgataaagacactttgcatgcgggacctcactggctgggctcctgctgttattcaggacccatgcaaatcccagaatcacgttcagaggaagacgatattaagatcacacttactagtcccattttcatccccagagccaggttcaaaaaaggttacttttcttccatcccctggtttctttatgggtgtcttaaaaaagaagaagaaaaaaaaaaggccatgagcataaatcagatcactgaaaaattagctcctgctgtctaaatctacacaaagtccagtcagcaataactgtggcaatcggcagaaaaaccctgccccacctgaccactggcaccctgacagacacctgggcagagcctgcctccttctcctaatgcaccctcctgcccacacccctgcccacaaagagcatctaacaaagtgcactaacctgtgaatgctgagctgcactctgcacccacaggaagacgggaagcatttaaccagaaagagcagagatgctagacggtagagcccaccaaggtggggaaagaagctttcagactgaagctaaacaaataaatcaagaatatttcctggagctgatatccaattaaaaaataaggtgacattccaaaattaacacccttacggggaaaatgttattacctaagaattttgtctaacacaacatcacctttctaagaagtaacaaaggacactctgaatgtcctacaagattctgaaatgaaaaaccctaaagccaagtctaagatctatactggtggtatctggggtcccagtcagttattaactggccatgactgatgctgtttctgtcaatatgactggcagacatgaatgaatcaggcctgatttcaagtttatctcaccaggaccattcagtgatgggaaagaagaaggtcagccatggcttttgctgaggtcctgcttaccacttctggcagacacgaatttttctttttacgttccttttttgttgttgttgagacagggtctgtcgcccaggctgagtgcagtggcatgatcacagctcactgcagccttgaccttccaaggctcaatcctcccatctcagccttgtagctcgggctacaggtacaagccaccatacctggctgatattttaattttttgtagagacagggtttcatcatgttgctcagactggtcttgaactcctggattcaaggcctcagcctcccaaattacaagtttgagccaccacacctggccgtgaatttttcaacaggggattattttcatctgatgtttaactcacataggaaaaaagaaatcccaaacctaaactttggatttggcctgtctctactgtcacactgtcttattttgccagaaaaatcaaagcctattccacaattaacgaaagcctaacagttataaatctttcacacaggcttcatttctagagtgcaaatcacacttagtaatttcagtcctaattacccttcatcctcatcctacaaatagagaggagcaagctgccctccacaaagcgtccccagaccacaaagatactgacacaatcaacgatctaacccagagcctcctggggccagtggacatgcgaggcccctctgagcacattatggtccaaatggatgagacactcctcagcaggactccttgaactgtcaggcagataaagccttgccttgaagcctgcccctggaggtgccccagttccctagggtgaggcgagagaccatcttgcaatcagagagcccacagcactcaccttctcctctgacttgagtgcgggtttggtgggctgcgcctgcgggactttgaaaccaaggatctccagcatgttctcggctgcattgcgcttggccaccttcttgttggtgcccgttccttctgcagtgtggtttccaaccttcacctgcacaaagaagtcaaaacacagaccagtgcttaaaccttcagaataacaaccaggcaggaattggtgtgtcagcaaaataaccaactatggtcagaagcaagataacagcagtgccccgaacctggcctccttgtctctgagagctaattattaaatagtcaggagtttgggaagctggctgttaaacacagccagtattaaacatttaattatataagctgataattattttaacagaggtaatttttgactgcattttataatcatctgtgttctgagggtctgcccagctattgcatttgtacaatggaaacagtctgtgatggtgaactactgtacatctattcccagcattgccattggaagtatcactttgagagcttgaaatcagccatggtgggactatttataccacagaaatatacaaatgctacgtatcaaagatcataagctgtttattgtctaactctaaacctacaatgatgaaaaggttaataaagcaggttaatcttaaaagcatgagaagtctgcagccattacattgtaactagcacaaaaaactgaaatatcttcccgtctttgaaaattatctaattttgcagagaagccactcatatcatttacaaatgagtgatgttacatgtcttcattgtttcactttttcttttttcttttttgggatagacagggtctcacttcttcacccaggatggagtgcaatggcatgatctcagctcactgcaacctccacttcccaggttcaagcgattctcctgcctcagccacccgagtagctgggattacaggcgtgtgccaccatgcctggctaacttttctatttttagcagaaatgagggttcaccatgttggtcaggctggtctcgaacccctgacctcaagtgatccgtcatgctgggattacaggcgtaagccatcaagcccagcctgttttactttcatcttacctattaacataaataaaaaacatcaaccagccgggcgtggtggctcacgcctgtaatcccagcactttgggaggctgaggtgggtggatcacctgaggtcaggagttcgagaccagtctggccaacatggtgaaaccccatctctactaaaaatacaaaaagtagctgggcgtgatggtgggcacccgtgaatcccagctactcgggaggctgaggcaggagaatcacttgaacctgggaggcagaggttgcagtgagccgagatcacaccactgccctgcagcctggacaacagagcaagttgactccattcccctctaccccaaaaaaaatgtatctcaaccagtattcatgctacaaccaaaatctcaaatctacagtatgtatttgtcagtgacatgagcaacacctttgctgaactggatagtaataaaccattatgtgctgtctgattttataacactatcgttggtaactgtcacactgaaatatgtatgaaatttacaataaagtgtatattatttataaattgtactacacatcctttctgtcagtaaaatttataaaacacacatatatgtcagtataatttataacacacatcctttgtgtcagtaaaatttataacacacatgtatataacacccatgtatatatctataacatacatattcagctcattccaccaaaccaccctccccgaagaagagctggttgttaaacatgttccagcacatcactacttacaacccccttccaagttgattgtaataacaggcacctggctgctaaaaccaaaagcccaggtcacaagactcagagagtcaaagaaaccattccctggcctgggactaaattccaacctggccatctaccagccatttcatcttgggcaaactactgatcctctcagcaaactgcaacttccttttgtggaatgaaaggatcattcttttcctaccttctgactgcataggtaaaatatacgaggtcaactttctaagttataaattgctatacaagagataaggattctgtcttacatcagaaagcacttaaattcaaatcacaattaagttaagctgcctatgtgaaatgaccacttagctttgaacttaatcagctaagtacaaagaaatgttccatactaatctgaagtgtcacccaatctaaggaagaggtaaccctagattccagactccataagaattaggaggaagaggaacagatctcttgatactacttacaaaatttacctttggtaaagagcaatgtcataaaccttcaaggagatgtaatgaagaaaaacttctcccagcacccaccaccccaggactctttcttccaaatttcagtgcaacacacccacattcccaccagtgcacccagcagtagtgctggtgtgcagacattacattcatttttttaagcattaagataaacaacttaatctttgatatgtagcctttacagatttctgtggtatgtttaagctatcaaattattgcaagccacaaggtcttaataaggatcacagttggctgggcgaggtggctcacgcctgtaatcccagcactttgggaggctgaggtgggaggatcacaaggtcaggagatcaaaaccatcctggccaacatggcgaaactccgtctctgctaaaaatacaaaaaattagctgggcatggtggcacgtgcctgtaatcccagctactcgggaggctgaggcaggagaatcgcttcaatcagggagtcggaggttgtagtgagctgagacagcaccactgcactccagcctgggcgacagagtgagactccatctcaaaaataaataaataaataaataaataaataaataaataaggatcacagtcgctggcagaacatggcccacaggatccagcctcctcaggaaggtgtccagaccttgaaccgccatcagcccccaaggctggacgtggtcagaggaaggggcgcccatcatccatgcggacccacctgcatcacaaactccctgcggcgcgggaggcctcgctctgtgaggagcgtgtactctggctccttctccttttttgcctgctggatctgggccagtcggctaatcggattgatcccctggccatattctgggcttgtctgtggctgaggaacaaacaaggcagaaactctgtaatgttattcaccgcatgaacttggtcaactcagagatcaggatatgagaggagataagagattttgggttgacctaatggctcagaattcgattttttttaatttaacattttaacaatgaaaagatgctttattttttttatgattgttctaggtgattttaaggtcttagcaaaccaacatcaacatttcactataacgaagcgtcactatgactgcgacggctgttttttaacatatttcaacatatgacagtaaatgggcagaaaaaacataaaacactattcctacaactccccaaaagtctgagctatgatgggttcccaattttcttgaaaagaactcaaaatccaggaaccacttttttaaaaaagctcaagctgatgccacatggcaagaagaacctcagaatcccagttacttccttgaggccaccttttgtgccaaggaaccctcactctgctgatcagaagtgacttccaggctatattaagcaaaaaagggaaacaaaaggtatacatagtatgcttttatgtaagaaaaatttggatcttgatacagcatgaaactacatatactgaaaatcacaaagttccccatggaattatgtcccctttctggggttggggaaggggtcaatataatgctttgatagatccattagtgtggctcaaaaatccaaaagaaaaggcacacagcaaaatgtctcactcctaccctcccactatgggcctcctgcctggcacaaatctcctccaccttcagaacagcaacatggtcactgagacacaggcactgttatttcaccacgcgccccacagaccggcatggcgttcctgcccaataccccactgtgatcgccagggctgtgatgagcgccctcctgcacagatgtgtgtgcccgtctgcgggtacctctactgaactgacacaatgtccttatcttacctaacaggtggctcttgcagcacctctaaggggtctggcaggcctggggtgtggcacgttggtctcatcccctttcaccttggggacagcgaccagccttctaaaccccccacccatctataagtaatgaaaacaccttctgtgttcagaaaagttctcaccttgactatgggttttgttttctttttgattctaggctttactcgttcaactgcaggcaggggcggtaacttcttcagctcctcaagaacagctatggcggcatttttctttgaaatcttcttgcttttcccttcaccttcccccacaaactccccaaccgaaaccttggtcacaaagttcttcatgtggggtgggccactctcccgggccacctgtttcagagggaaagactgagtgaaagcggacagacacttattaaaagctccaaggcacactggctggcacacttcacacagacacagggaaggggaaccaaggacaagacctactaaatgaaaggaagcggggatcatttcaaatgctttctcgcctttcttcttacttctcaaactggtttatgctcttgagtctggtgagtcccaaacagtcaggcatgaaatagggagacctttttactcccatgcccctggctcacaggctgtcctgagtttagtgtggtccactgcaactggcaaaaaggaagctagcccagcaaagtccagaaataaatgcagtacaaatgctcaagtttagtatctgctctgagcctccagccaggactaggcctactaaatactggttgctatgtggccacaaaagagaacgagacaaatctcttaagcactgataaagagggattccccgcacacattaagtaaaaaaaaaaaaaaaaaaaacccacaaaagagtatatggtatggtagctttagtttaagaaaaataggattttatacaaatatctacacatatataaacagacacacatttataagctcatttttgcaaaaaaaaaaaaaaaaaaaaaaaaaacgaaggataaaaaaaatcaatgggctggacatggtggctcacacctgtaatcccagcaatttgggagaccaaagcgggtggatcacttgaggtcaggagttcaagaccagcctggccaacatggtgaaacccccatctctactaaaaatacaaaaattagctaggggtggtggtgcacacctgtaatcccagctacttgggaggctgaggcacaaaaaccccttgaacctgagagacggaggttgcagtgatccaagatcacaaaactgcactccagcctaagcgatagagtaagaccctgtctcaaaggaaaaaaaaaaaaaaaaaaaagcaagcaatgggccaggcgcggtggctcacgcctgtaatcccagcactttgggaggccgaggcaggtggatcacgaggtcaggagatcgagaccatcctggctaacatggtgaaaccccgtctctactaaaaatacaaaaaaaattagccgggcgtggtggcaggcgcctgtagtcccagctactcgggaggctgaagcaggagaatggcgtgaacctgggaggcggagcttgcagtgagctgagattgcgccactccagcctgggtgacagagtgggactccgtctcaaaaagcaagcaatgaaattagttacctacaacaggtgtgagggattagggtagacagacgggatgagacgggaatgatagttttgacttctggaagcatttactgttttacatattaaagaaataaaactaagtcaacaaagatggggaaagaatctaaaattaaacatgaacagaaagttagctgcatattaaagtgattacaatctccaaatggaccaaagacctacacagaggcgctaacatgcacaactctcagaagcaaaaacaggcgagtcttcatgactttgggtttggcaattggtttttaagatatgaaactaaaagcacaatcaacaagagggaaaaaaaaaagtcacacttaatcaaactttaaaacttttgtgtatcatggacattatcaagaaagtgattacaataacacagatagaaaatcaggctgggcagggtggctcatgcctgtaatcccaacgctctgggaggccagggtgggaggatcacttgagctcagaagttcaagaccagcctggccaatacagcaagaccttgactctacaaaaataaaaacaaaattagccaggtgtggtagtgtgcccctgtatgtagtcctagctatgtgggaggctaaaacaggaggatcacttaagcccaggagatcaaggctacagggagctatgatcacacaactgcaccccagcctgggcaacagagcaaaacctcgtctcaaaaagcaaaaaaaaaaaaacaaaaaaaaaacaaaaaaacttaaaaatctaaccgatattagccaagacactcaaaaagaaaaatagaagacttacactaccagattttaaaacttcctataaagtcacaacaactaggatatggttttgtgtaaggataaatagatcaacagaacagcacgaaaaagacctgcacatataaggtcactcgatttttggcaaacacaccaaaacaaattaaaaatctcttaaaaaaatagtaccagagcaactaactaggtatctgcatggagcggggtggggggaagaaaaaaaaatcaaaccatgatctctaactcataccacaacaaaaattagacctaggatcacttaaatgtgatctaaactaaaattacaaagactttataacaggagaaagcctcaagactgtaaggctggcaaagagttgaacacaaaagatatccaccataaagaaaaaagaaattcctcaaaattaaaaaccactggccgggcgcggtggctcacgcctgtaatcccagcactttgggaggccgaggtgggcagatcacgaggtcaggagttcgagatcagcctggccaacatagtgaaaccccgtctctactaaaaatataaaaaattagctgggcgtggtggcgggcacctgtaatcccagctacttaggaggctgagacaggagaattgcttgaacccaggagacggaggttgcagtgagctgagatggcaccactgcactccagcctggacaacaagagcgaaacaccatctcaaaaataaataaatgaataaaataaaaaataaactgctcatcaaaagacatttaaaaagtaaaaaagggggccaggtgcagtggctcacgcctgtaataccaacactgtggtaggccgaggcgggtggatcacctgaggtcaggagtttgagaccagcttggccaacagggtgaaaccctgtctctactaaaaatacaaaaattagctgagtgtggtgacacatgactgtaatcccagttacttaagaggctaacacaggagaaatgcttgaaccccagaggcggaggttgcagtgagctgagatcgcgccattgcattccagcccggatgacagagcaagactttgtctaaaaaacaaaaaaaactaaaaaaggggccaggcacattggctcactcttgtaatcccagcactttgagaaggccaaggcgggtggatggcttcagtccaggagtttgagaccagcctgggcaacatggcaaaaccccgtctctacaaaaaaaatacaaaaattggctgggctcggtggctcacgcctgtaatcccagcactttgggaggccgaggcaggcggatcacctgaggccaggagtttgagaccagcctgaccaacatggagaaaccccatctctactaaaaatacaaaattacctgggcgtggtagcgcatgcccataatcccagctactcgggaggctgaggcaggagaatcgcttgaacccaggaggcagaggttgcggtaagctgagatcacgccattgcactccagcctgggcaacaagagcgaaactctgtctcagaggaaaaaaaaaaaatacaaaaattagcccagtgtgtggtggcgtgtgcctgtagccccagctacttgggaggctgagacagcaggatcacttgagctcaggaggtcgaggttgcagtgaggtgagatcatgccactgcactacagcccgggtaccaagtgagttcttttctctaaaatcaaataaaataaacttgttatttcaaaatatacatatttcctagctctatctcctaaccgagagccatggctctccagcaggaacaagcatgctagcaccctgtcctgtctctacacaccactcccaattagaaggaaccggatcttcttggaggaatggccaagaccatttctattagaaatttatgtttccactggggctaaagctagagcaggggaagttcaaagtgaggctaaaacattttgttgtatcagaaagcatggaagttctcaaaatgtgaagaggggaggtgcaaaggttatttaataaaggactgtctcagccaggcatggtggctcaagcctgtaatcccagcctgggcgacaagagcaaaactctgtctcaaaaaataaaggactgtctcttcaacaaacagtgcaggcacaattagacatccaaatccaaaaaaaaaaaaaaaaaaaagacaaaaacatcccttatgtcacagtatatatgaaaactaactcgaaatgaattataaacctaaatgtaagagctaaaactaaaatttctaaggaaaatgactttaggttagccaaatgtatctcagcatacacaaaaattattaactataaaaaatttaacaaactacacctcaccaaaattcaatacttctgctttttgaaagtcacttaaaatcaaacgacaagccacagacttaagagaaaatatctgcaaaatacttatctgagaaaaaacttgaattcagaatatatatagaacctccaaaactcaataataaaaagacactcaaaaaaactggcaagatataaacctatatttcatcaaagaaaatagtaaaataaaaacacgaaaagaagctcagtattgctagtcttcatggagatatataaattaaaaccacaacaagatactactgactacctgctagaatgactttaaaaaaaaatttttttttttttttttttttttttgagacggagtctcactctgtcacccagggtggaacgcagtggcgcgatcttggctcactgcaacctctgcctcctgggttcaagcgtttctcctccctcagccccctgagtacctgggactacaggtgcacacaaccatgcccacctaatttttgtatttttagtagagaaggggttacgctatgttggccaggctggaataactaaaattttaaaagctgacaatacccaagtgttggagaggatgtagagcaactaagcctctctcatatattgcaggtgaaatgcacaatgatacatctggtttagaaaacagtttggcaacttttttttttttttttttttttttgagacagtctcgccctgtcgcccaggttggagtgcagtagcatgatctcggctcactgcaacctctgactcccaggttcaagcgattctcatgcctcagtctaatgagtagctgggattacaggcacatgcctggctaattttttgtatttttagtagagacgaggtttcaccatgttggccaggctggtctctaactcctgacctcaagtgatccgcccaccttggtttcctgaagtgttgggattacaggcatgagcccatgagcccagccaacttcttataaagttatttatttatcatgcaactcagcaaatccactcaagtatttattcaagaaaaatgaaaacatgtctccacagatgtatataaatgtttacagtagatttattaataatcaccaaaaactcacaacaatacaaatcttcaactggtaaatagatacactgtagtgtgtacacactatgtaacactcttggtgataaaaaggaacaaactactgaaacacacaacagcatgaataatgactccaagctaagttaaagaagtcagacaaaaggcaatatactctattttccatttatgtaatattcttaaaaaggcaacactatagggacagaatgagatcaatgcttgccagagcctgaggacagaggggagagactgactgcaaagggacacagggaactttactgggtgggagatgttctgttttgactatggtgctggttacagaaccatatacacttatcaaaacacatcgaactgtgcacttacacagggtgactttcactgtaaattatacctcaagaagcctgaccaccccttcatccaaaaaataactgatgggggcatgttaaagggcacaagggccaatttaaaggacaatttggacatcaaaatgggtgacgataacaatggagtaatactttgggtttaaaaaaaagcagcaatgcatctataccgatataattactataagaggggaggaaggaaactttttctttactgtagaatgccagcttggaaatgccaaaaatcataattttgacatctaccacagtgataatcaatgccagcaagaatcatcaagatccctgaggggtgggtgtggtggctcacgcctgtaatcccagcactctgggaggccaaggtgcatgcctaatcctagctacttgggaggctgaggcaggagaatcatttgaacccgggagccagaggttgcagtgagctgagatcacatcactgcaccccagcctgggcaacagagcgagactccgtctcaaaaaaaaaaaaaagattgctggaaccaccggggagacctgtgaaggcccagccttcaaacatctcctcagaggttaggagttaattacaaagtgacatgaaatgatgctctgagaaggatcaatatcactcccatggtgatcctgccaaaaaacacataaccagacctaatcataagtaatccatcagaaatacccaaattgagggccactgtacaaaaataactgacctttaaacatgtcaatgtcatgaaacacagagaaaggctgagaatgtactgcagatactaaagatactgcagagactaaagagaaaggtcagctaaatgtaaggtgtgagtctgcatcagacactagagcggaagaaacatttctataaaggacatcattgagacaactggtgaaatgtgaatgtaggatgtgtattaggtaacagtactatagcaatgctaaatttcctctacttaatagattgtggttatttaagagaatgtccttgctcttaagagatacatgctgaaatattaggagttaaagggtatgatatctaccactttctgtcaaataatccagcaaagtaaaaaacagaaaataatatgtatatttatggaaaaagaaaaagcaggctgggtgcagtggctcacacctgtaatcccagcactttgggaggccaaggcaggcagatcgcttgaggtcaggagttcaagaccagcctggccaacatggtgaaatcccatctctactaaaaatacaaaaattagccgagtgtggtggcgtgcacctgtaatcccagctactcaggaggctgaggcaggagaattgcttgaatccaggaggcagaggttgcagtgagccgagatcatgccactgttctctagcctgggcaacagagttaggctccgtcacaaaaaaaaaaaaaacaaaaggaaggaaggagcaagcaaatatggtaaaatgttaaccactggttaatctaagtgaaagttatattcattgtcctattcttgtaacttttagatagatttgaaatttttgaagtaaaaaattgaaaaaatgtctaggtaagaaaagtgagcctccaaaatggatgcactctttttttttttggtgtaggggaaggaggtagcggagaatggggggtaggaattcagcacagtggccaggagcagaggtgtgggaaggacctggcctgcttaggcacccgtggactgattttaaagaactcccataggtgccgcccacacccaagggcagagattctgaaacacttcttcccacaacagtgctttccctgtcctcaggttagactttggagggacaggtcagccaccctgatggctcacttcaaatgcacagcccaccctggccctctccaacggcttgcattgtctgcccacatcaagatccccccaatctaaatctggaggatcacctggattgcatgtggtgtgagcatgtcacaattgtctcccgatgaccgtatccatcagcaccatcacattttctaactaaaactgtatgttttatcagaagtcaaactggctgggcacggtggctcatgcctataatcccatcactttaggagatcaaggtgagtggatcacctgaggtcaggagttcaagaccagactggctaacgtggtgaaaccctgtctctactaaaaatacaaaaattagtgaggcatggtggtgtgcacctgtaatcccagctactcagggggctgaggcaggagaattgcttgaagccaggaggtggaggttgccataagctgagatcgtgccattgtactccagcctgcgcaacaagagcaaaactccatctccaaaacaaaacaaaacaaaacaaaagtcaagctgtatatatttttccaaaaaactgttcctgtcttcccctattaaaacacctaacgaagcttcctatgtgacagatttaattaccaaaaacttaatcaaaaattattctgttcatttattcagtaactatttcctaaacatctaatacatgccaggcaaccttccagcggcaaaagaaaggaaagaccttgctcaacataataatgcaagctagtaaaaaattcctgatatttgagttaatgaatataagcactcacgccaccaactacatgcaagctgtgataaattactttaaaagatcaccacgagagggcactcctacaattcttttatgtgactactgtcaagattcctgaacacagagttgagagccagatctgaaaccttaacaaaagtgaaggaggaaaggaagcaatctgaccccaaatcccacagaacaaaaacataaaatagcaatctctaagtttccagaaatctcagtgactctgggtagcagcaagagtgagcaggtggtaagcttctcaggaatccaaggctctggcccaagccgtcaactctgcacatgaggtgacccgggaagccagccaggcatctcccactccccacggtcttggtacccctcccccacaacctgcaaaaatccactctcatgacagactaatctgtcagcaggggagaaaagcaacacttctcccctttcctgaaacaggtgccgggggagacctcatgactccttgggatgcagctcccatctttttcccactcaactgtgagcccaaacagccattctgaatgtcccctgtctcattccctccccaagtgcatcccagcctccactgatggagggagaaaggccagggagggaatgtagggccaggtgagaagattccagccctagatccatgtcggtgctctggactccaagagaacagtgtaaacctgctcttacccactgagggtggaggggcaggaatgagtgtcagaggaatggagaggaacaaacaagccctcgtacccaggtgggccacagtagggagccctggcaactacaatcccacctctggcccatggcaggcagagaggcatcagcagggtgaggtgagaaatcatcatcactcggccaaaggatggagcactgaagctgggttaagtttagggtgctagcacataggaggagaaggtatacatcacctgtaactgtaaagaatacttcaaagatattttacaggaatataagcttcagataggctttttaagaaataagccataatcaagcacgtaaatcaaaagaatctgcaaagaatctgctgtgggtcagaccttatttctaaggtaaacattaaaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcagggaaaaaaaaaaaaaaagctctgggttgaaacccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgcaattccaaaagtcaaggtgagaaagaaatgtatacactgggaatcattagttttcccattcctggagagcctggttttccacttcacgcaatttataccaaacctgcaaacaaacaggaagatgaagtgatgagagcctatttacaacagctaaggcaagagactggactgagactttgtgaggaagttttcgaccctaagaatgataaacccagcacgtggtggacttgctttgtgaagagacagttcatgaacaagagtctttcaggacctggacagcgaagggagcccgggcagccgccatctccagagccctgggcagcattttccagcaagatgtacacaatcttttgcctttattcgtaacgttttatatagaagagagaagagcatgtctttacttgaaaaactcttgatcaagaatttgggtgggagaaaagaaagtgggttatcaagggtgatgtgaaattttctgcagcattaagctggcgcttaataaaaataagtaacaaaaaaaattctcccttacctccctcgtccatttggatgaactatatgtcttttaaggcaacatatattaaaatgtaccttatttcccactttgatcagacaattcattgattattgtttttagaacacaaggtctcaacaacaaatgaagttattaaacaggaattgagggcagacgctagacaatgacaaaaactgagtccttttcaaaattactctgaagagacctttagggaccacaaatgcttttgagactgatctaagtgatgaactagcccctccacccttccctatccagaagaatacacatatgaacactaacacaaccatcttcagactgcttcaggaggtccacacaccaactgaagccatcatgaactctctacacatccatgaatgccccttagttacggactcccagaagaagagaataaacactgcttcactaaatataaagtatgaatcttaaatttggaggttcacattatgtgaagattattccaatgatatttaggggaaaaaataactcttatgatgaatgctaacaggattttagaatacaaagtcctacatgtaaaattagcttacctcgaaattcacaggcaagttccgtttaagtgcaatctcaaacacttgacttatttcagatttattgagattttcttcttcggattctcttccattcacctgtaagaataattgtttagtagttagctcttattaaaatagtcaatggccaggtgagttggttcatgcttgtaatcccagcactttgaaggctaaggcaggaggatagcttgagcccaggagtctgagaccagcctgagcaacatggcagtttgagaccagcctgagcaaccttgtctctaaaacaaaaacaaaaacaaaaacaaaaaaacaaaacttaggtggatgtggtggtggtacatgcctgtagttccaactacttggagggctgaggcaggagcattgcttgagcccaggagatcgaggctgcagtaagccatgatcatgcgccactgcactccagcctgggtgacacagcgagacgctgtcccccacaaaaaaacacccatcaacatcctagctgcaatggtaaaccttaaaagcactgagctttggctttatgaatttaaccacacacataccaagtgtcactgaatttaagaggttaaaaagatacatgtcctgtcaagtttgagtcaaattgtacctcataagttcaccaaaaacaatccgcacataatagacctttggatatgtgtcagcctgactgtggttcagcaagatgtcactgctgctcggaacagtgacttccaaaagtccttctcaagtagtgggaagccacattttggaaaagtcaaaatacagacagatatatgtgggacgtggcaaattcagattaagtctgtccacatgagtatgcaggcttatttgaacataaattccctggaaaccactttttttttttgagatggagtctcgctctgttgcccaggatggagtgcagtggcgcgattttggctcactgctacctccacctcccaggttcaagcgattctcctgcctcagcctcctgagtagctgggattgcaggcatgcgccaccacacccagctaatttttgtatttttagtagatacggggtttcaccatgttggtcaggctggtctcgaactcctgacctcatgatccacccacctcggctcccaaagtgctgggattaaggcgtgagccaccacgcccggcgggaaaccactttaagagaatgcagccatgcgcatggcagtacacgactattgccccagtactcagcaaggtgacagttgaggatcagttgagcccaatagttcaaggctacagtgagctgtgatcatgcctgtaaacagccactgaactccagcatgggcaacaaagactctctatctctataattaaaaataaagaaataaataaggatgcgatgaaacacattacaaaactgccatgtatctcatactcaacggctgttggcaaaaaaatacaaggcgcaaactaataaagtctcctcaacaaaggcagagattccatctttggaacaaggttcacttaagagtcgtccaatcagggatgagattaaagaggagcaaggatcttacttctgcgtgctgataacatggattttatactgtgctgtagtgataataagaggaactagataagctcaaagcttatctagcaaagtcccccaaaacaaaaagagctgtttttcttcacattattgcttattttgtcaaagaatttataaagtcctgcttctgagattagaactatctgaaaaggaacccatggctgaaactgctaaataggcaaggtataggactatccaagattttatctgttgtgcatttccttatgtttatcaggtatattccacctacactcaacttttttttttttgagatggagttttgctcgtgtcgcccaggctggagtccaatggcatgaccttggatcactgcaacgtctgcctcctgggttcaagcgattctcctgcctcagcctcccaagtaggtgggattacaggcacccaccaccacacccggctaatttttttttttttttttttgtatctttagcacagatggggtttcaccatcttggccaggctattctcgaactcctgacttcaggtgatccgcccaccttggcctcctgaagtgctgggattacagacatgagccaccgtgtctggccactgaatattaaaagctgtaattggctgggcatggtggctagcgcctgtgatcccaaaactttttaaggacaaggtgggtggattgcttatgcccagtttgagaccagcgtgggcaacatggcaaaaccccatctttataaaaaaaatacaaatattagcaggtgcggtgtcgcacatctgtggtcccagctacttgggaggctgaggggagaggatcacctgagcctagggtgttgaggctgaggtggctatgatcacgccactgcattctagcctcagtgacagtgtgagaccgtgtcacacccaccaaaaaaagctataattaaaataaaacaaactctaggttaaaaaaatatatatataaccaagggtataatcctggacaaataaatttattccagatgctctttgtaattccttctatccttccataatcttttctttccaatctggtttcagtgtatctcacctgagtcaaaactactttcatagcacttgtggtggtttattaacctacacatacttttttttgttttttggagacagtgtctcacactgttgcccagtctgaaggacagtggtacaaacatagctcactgcagcttcaaactcctgacctcaagcaatattcccatctcaccctcctgagtagctgggactactggcataggcaccactcccagctattttttttaatgttttgtagagatggggtctcactatgttgtccaggctggtcttgaactgggctcaagcaaccctcccacctcaacctcccaaagtgttgggatttataggtgtgagccaccatacccagcccacacttgtatttttgtttaaatcctaagcagaaaaagggtctacttttttatgagtgaatccttaaaactggcaatttgcaagcaaggtaccttaaaggctggagttctacagaggtttggcttgaaatttacaggttggtgcaaaagtaattaccaatctaatagttaaatagatattaaacttaaaaaaaaaatactgtaagcttgttcaacaaatggtgctaggaaaactagatatccacatgcaaaataataaggcaggacccttaccccacaccactaaaaactcaaaatggatcaaatacttaaacataagagctaaaacagtaaagttcctagatgaaaacataggggaaaagtgttatgacaccatctggtgatttcttacatatgacatgaaaaccgcagacaacaaaagaaacattaatattagacttcatcaaaatttaaaacattcatgcatcaaaggacactatcaagagagtgaagaaaacccacagaatgggatttgcaaatcatttatctcataagggattaatatccagaatatataaagaactacaactcaacaataaaacaacccaattagaaaatgggcaaagcacttacacaggcatttctctaaagaaatacaaatagtcggctgggcacagtggctcatgcccgtaatcccagcactttgggaggccgaagcaggtgggtcacctgaggtcagaggttcgagaccagcctggccaacatggtgaaataccatctccactaaaaatacaaaaaactagccgggtgtggtagcagacgtctgtaatcccagctacttgggaggctgaggcaggagaatcacttgaacccaggaggcagagattgcagtgagctgagattatgccactgcactccagcttgggcaacaagagcgaaactctgtttcaaaaaaaaaaaaatccacagtaagataccactcacacccataaggatggctgctatcaaaagaaatggaaataacaagtttttggatatggagaaatgagaagcttccagtcacttatgaaaatgtaaaatggttgtaccagatttggattttattaaaaataaaatagaaaatgggcagtgcgtgcggtggctcacacctgtaatcccagcactttgggaggccgaggcaggcggatcacctgaggtcaggagttcgagaccagcctggccaacatggtgaaacaccatctctactaaaaatacaaaaattagctgagcgtggtgacgcgcacctgtagtcccagctactcgggaggctgaggcaggagaatcgcttgaacccaggaggcggaggttgcagtgagccgagatcacgccactgcattccagtccagtgagactccgtctcaaaaaaaaaaaaagtaagttaattaatttaatagaaaatgtaaaatggtacagttgctatggaaaacagcttggtagttcctcaaaaaattaaacatataattattatatgatccaggaattccacttctagatatacacccaaaagacctgaaagtagcaacttgaacacatttttatacaccagggttcacagcagcattcacaatagccagaaggtaaaaacaacccaaatgtccatcaacagatgactggaaaaacaaatatttactattcataccataaaacattcacccttaaaaaagaaatgaaattctgaaacatgctataacagagacgaaccttgaaaacattacagtaagtaacataagccacacattaaaaaaaaaatccatttttatgaagtgcctaggctaggcaaatgcatagaaacagaaagtaaagtagaggttaccaagggccacgagcaagggagtggggagtaactcttcaatgagtccagaatttctatttggaatgatggaaaggttctgaaaattagtagtgacagttgtgcaaaaccaagaatgtattttaatgccactggtgcacttaaaaatgtttaataattttagatgtatattttgcctgaattttttaaaaagcagcaacaaaaatgtttcacaccaaatattaagataccagaaatcatcaacacagtaacttgtgctaaccccagattaactcatttttgtgcacaacagaataaagcttgacagctgtttccctgaagagcatccagagttttttttaatagatgatctgtttaaaaaaaaaaaaaaaaaggtccacatgctaagaactgtgccaatgagaatgctctttatgagcagccagaacacaacttggaaataaactaggtgctcagactgtcgtaagactttgaatgccacgtacatgccccaattttcaatgttttgttcattgtatcagcccaattaggtttaacttttatttttatttacaacctatttcaaacatacagaaaagtacagataataacataacaggcaatttcctggatttatccaatgtcaatagttaagtactactgacgtcggactgtttttttctgttttaagaaaaacaatgagccacgcatggtggctcacgcctgtagtcccaacacttctggaggctgagatggatggtttgtttgaagtcaggagttcaagatcagtctaggcaacaaagtgagaccttaatctctacaaaaaaattttaagattacccaggtgcagtggagtgtgcctatagtcccagctactggggtggctgaagcaaaaagatcacttgattgattgcccaggagtttaaggctgcagtgagctatgatcgtgccactgcactccagcctgggtggcagagcaagactccatctcaaaacacaaggcaacgggccaggcgaggtggctcatgcctgtaatcccagcactctggaaggccaaggcaggcggatcacttgaggtcaggagttcgagaccagcctggccaacatgacgaaaccccatctctactaaaaatacagaaagtagccgggtgagactctgtctcaaaaaaagaggcaatgaaggccatctcactatcattcccagggcagttaatcactatcctaaagtgggactgtatctttcccagccgtgtttttaaatgaatataatttggtgtttttgaaaactcatatacctcattctcagaaattgcctttaccattattataaatccaaacttataagtttatactaataactgtaattccagcactttgggaggtcaaggcgggagggtcacttgaggcctggagtttgagaccagcctgggcaacataataagacctcatctcaacaagaacaacaacaacaacaaatatttattttttattttgtttttgagatgaagtctcgctctgttgcccagactggagtgcagtggtgcaatcttggctcactgcaacctccgcctcctgggttccagtgattctcctgcctcagcctcccaaggagctgggactacaggcacaagccaccatgcctggctaattttttgtatttttagtagagatggggtttcgtcatgctggccaggctgatctcgaactcctgacctcaggtgatccacccacctcggcctcccaaagtgctggaattacaggcgtgagccaccgtgcccagccaaaaaaaaatttttttaaataacaatttatactaacgaaatgctccttttctattttatatacatgtatcaaggttccacgtaagactgatagaaaacaatgggtctactgctccgttctacaccctaagccagtggttctcaaccacagcagcactacaatcacttgggagcttcacaagttcagattctggagcccgctccagacaactgaactcaaatttttgagggcatggcctggatagcagttttatttatagtatttgtttattttttaaataagtccccaggtgactggagttgcgattcactgctctaagccattgcttccagaggagtatcattaggaacaaagcagccagtaaaataaaaatgcaaaaaaacatatttgaaaatgaaattattttgctcttttacacaatttttttcttttgagacagggcctcagctctgtgccctcagctgcagtgcaatggcataatcagagctcactgcggccttgatctcccaggctcaagcaattctcctgcctcagcctcctcattagctgagactacaggtacatgccaccatttcgttttttcaaatatttttggtagagatgaggtctctccatcttgtccaggatggtctcaaactcctaggctcaagtgatcctcccacctcagcctcccaaagtactggaattataggagtgagccaccgtgcctggctcattaaaaatttcctattatccagactgacaaaatgttccaagtagggaggcagcaaatggttcaaaactaatctacaaaaaccattcccagtaaaatgaggaaggtttagtgggcacttagtcttatcttcacaatgtaggaattactgttaacactgattccatagtgtatagttcagcaataaaatctaggcaacattaagaaagaggccaggtgtgatagctcatccctataatctctgcactttgagaggccacggtgggcggatcacttgagcccaggagttcaaaaccagcctgggcaacatggcaaaacccgcatctctacaaaaaatacaaaaactagccaggtgtggtggcatacacctgtagtcccagctacgagggagactgagatgggaagatcacttgaggccaagaggtcaaggctgtagtaagccacaatcgtgccactgcactccagctagggcgacagaggaagaccctatttcaaaacaaaacaaaacaacagaaaagaaagaaatgctctgaaccacacttaaccctcacagtatgctaggaaaattagccatcaccatttattatctggctccaacagactcttctgtttttctatatctaaagtcattttacaaataatttaccaaataaaaggatgacaaaagccattttattagacattttaataagaacttaaacacagcaaacccagcttcttatcccaatgtttctaatttggaaggcatatatacctgaaaaaaagcaaggtcctctatatgcaactaactgctcatcacctgatgcacctgcagctggggcacagcccacctgtagcgatgtcagattccaagtccatctccaacaggttctaacttaacaggacttcagattcttcgtgtactggcactgtcaaacacactacttttgaaacagactcataattctgttgaagagaaagcagccatttccttgctccattaagtgcaaaatgctttcatttttggattataaacaccaacagaaggatcaatccagttatttttgtcatttttatatctattttcttccaatcacctttggacacacacctccttgtgcatttgtccagttattttgttgacaataagtggtaagaaataaatgttggcggccaaacataaaagataaaagaatgttgtcacacgtacttttttttttttaaatgcaaacaggatgggagaggttcttgtcgaaaaatgttgcatgatgaagtcctttctgttgaatgactagatgagaatataccacatttcctttccatacatcagataaataatcactagctgattcttgagtttggggaaattcatctatgctagcatctgaagactcacagtctgcgattttgcttagacaatctcaccatcatcattacagtctggagtgctgccatctatctgtctttttgtgttcatcttctgatttgttaatcatcagaaatgtcttcctctgtcaattctcttctccttgacattacagatgaaaaatagaaaaattctggattctcacctgggttcaatgaaagcaaaaaggagactcaaaagatggtgtctctagtcttctttttttaacctcttggaagacaatgcaatagcctaggcaaggccataggacaataaaagaaggtgtcatcatgacaattacttcactattgtatatccaccccagaggctttatcattcttccattttcttatgattttcatctcatctggcatatttgggagtagatgatgaatagtattgaaataattatgtggaataacaaatagcaaaacgttcaaaacacaggaaaattaagatccctaagatcccatcatgtaaagacttacaaaaggatccaaaagacccctatgataattgtaagacagaaagagttttgcactattttaaaatataagtatactttctctcagttctttgtaatacctctaaaaaagaatacaactcatgcaatatcattccttaaagagcttgaaaaagcagcttaaaaaatgaaaacctggctgggcgtggtggctcacgcctgtaatcccagcactttgggaggctgaggcgggtggatcacgaggtcaggagttcgagatgagcctggccaacatggtgaaaccccatctctactaaaaatacaaaaattagccggcggtagtggcacgcacctgtagtcccagctacttgggaggctgaggcagaagaattgcttgaagctgggaggcggaggttgcagtgagccgagattacaccactgcactccagcctgggcaacaaagcgagactccgtctcaaaaaaaaaaaaaaaaaaaaaaaaaaagaccaagcgtggtggctcacgtctgtaatcccagcactttgggaggccgaggcaggtggatcacaaggtcaggagattgagaccatcctggccaacatggtgaaaccccgtctctactaaaaatacaaaattagctgggtgtggtggcacatgcctgtaatcccagctactcgggaggctatggcaggagaatagcttgaatcagggagtcggaggttgcagtgagccgagatcgcaccactgcactgcagcctggcaacagagcgagactccgtcttaaaaaaaaaaaagaaaagaaaacctgagccaggcacaagcatgcctgcagtcccagataatcaagaggcaaaaggatcacttgaatccaggacttcaaggccacagggtactatgatcatgtctgtgtacagccactgcactccagcctgggcaacaatagtgagacctgtctctgttagaaaaaaataaaaaagaaaaagaaaactaggtccaatgaacactgaggaaacaagaagggttaaagtctccaatttcaggccaggcgctatggctcatgccagtaatcccagcattttgggaggccgaggcaggtggtggtcacttgagctcaggagttcgacaccagcctgggaaacatggtgaaacctcgtctctaccaaagatacaaaaattaggtgtggtggcatgcacctgtggtcctagctacttgggaggctgaggtggaaggactgcttgagtccaggaggcggaggttgcagtgagccaaaatcacaccactacactccagcctgagtgacagagtgagacaccatctcaagaaaataaataaataaacaaatgggtctctaattttaactttactcctaattaagtatgcacctatcccaagtgaagataaagactcaaaaccagaaagagctgcatttattcatttttacaaaagtataaaaaagtattttaaaaacttcaggatgtttacggtggctcatgcctgtaatcccaggattctgggaggccaagctgggcagatcatttaagactaggagtttaagaccagccagggcaacatggcaaaaccccatctctacaaaaaatacaaaaattaacagggagtggtggcatgaatctatagtcccagctacttaggaggctgagatgggaggatcacctaagcccagggaggtcaaggctgcagtgagcctgcatggagggcctccgcactccagcctgggcaacagagtgagaccctatctccaaaaaaaaaaaaaggaaagaaagaaacaaaaatacatacacactgaaacaccaacaggatcacactgtatgcacagtaacagctctgcatcttcatcccttttcatgcctgcctatatgagatatctcactctggtactcaggggataaacgtagccaagtttttaaccactttcctagtaacagacatttaagctagcccccgtttttctctattacagatactgcagctatgaccatactgctcctaatagctcagacactgagtaaaactcatacttcattagcacaaaccttagattaaataaacaaataacccatgcactttcttaacttggggcctttgcaactgccactccctctctgggcatacactgtccctgccctttgctgatctttagtatcagccgaaatgtctcttcctctgaaaagactgctctgaactcaccaccattattccaacctaaatgagatactttacgttcttctaattcttgtcatttttccatccttgcactaaatgcactttttgctgatattaatgttaatgtctggcagctccatttgactaagttcacaggaaaagggatggcgctgactgtttcaactcagggtctagcacagcgcctggcatggagggcccagactatgcctgccctgtagacagcaagcgctggctttactgcatatcttctagagaagatgcactgatccaccacacaatcacatgctccacaaatatgccacagctaaactgacaatttgtttaaaatgatcatttccaatgctggcaggctgtggacagacgggctgcttatggcctgtcagcaggttgtaaaatggcaccctctttctgtggagaacttggccatatgtaccaccatgcatacccgctggttcagcaattccacttctaggaccgtggacaaagactttaactgcaacgatgttcttcccgacccattttataagagggaaaatgcaaacaacctaaataatcaagtccctgttggaaaataaagcagtgcattcacatagtggaacattttgtagccattagaaagtgcttaggtgtgtgctgaatttgggtcctccaaggaattttaagtaaatgacgtaacatattcaagatatacacatcagtgaaaaaaggtggttactgtacactgtcatgccatttttatgaaatagataggcatctgtatttacttgtatatgtgcttgtcagtgaatatacaccaaatggttacagtgattatccgcaagtggtaaatttataaatcattcattgttccttgtttttgaatttaaaattttttatagtccatatgcactatttttaagaaaaaaaaagttatcttttaaaactgtctctctttattcccctactgcctgctatcagagagcctggtaaaatcaagggcagcacatttacgaaagaggccaagtgtttcacttattgcaggctgagcattcctaattcaaaaatccaaaacctaaaatgctccaaaaatcaaactttttgaacaccaacacaatgccacaagtggaaattccgtacatgacctcatgcaacgtgtcgcagtcaaaacagtttattcaatacccccaagaaaaaaataaaattacattcaggctttctgtataaggtgtatacgaaacacaaataaatttcatgtttagacttgggtcccattcccaagatatcccattacgtatgatggaaatattccaaaatcaaaaaaagctctgaaatccaaaacacttctagtcgcaagcgtttagggtaagggatattcatctagtacttcaaataagtcttttctgaattaatgactcttcacttcactggctaaggccagtctttaagccatttctgacaggcacggtctctacttccaactctacagagctagaaaaggggcatagagaagaaacgccaaagggcacaagtagatttaaacaccactcccagcaaagctcctcagagatttcataggacccggtgaaaactcagcccagaagaacatgtctacaacagccgctgccctcaggactgtgccaaccaacgctgctctagtgagtgaaggcgggagactcagaaacaccaacaggcacttatcctttgtagcaatactgtgatcactctcatggaggactcaaggggaggaactgctggggaagtgctgacagctcttagatctgtggttccccaaccttgaccatacctcagaatcactccaagagctcattaacaacaacatggccaggtatggtggctcatgcccataatcccagcactttggaaggccaaggtggtcagatcacctgagctcaggagcttgagaccagcctgggcagtacagtgaaaccccatctctactaaaaatacaaaaattagctgggcgtggtggtgagcacctgtagtcccagctactcaggaagctgaagcacaagaattgcttgaacccaggaggtggaggttgcagtgaaccaagatcatgccactacactccagcctgggtgacagggagagactgtctcaaaacacacacacacacacacacacacacacacacacacacaccagcaagaacaacaaaagcagggagagactgtctcaaaacacacacacacacacccccaagcaagtacaacaaaagcaaaagccagattcctgggtctcaccctacacctattgcattagaatcccggggttgggcctagaatttatttttttaacttctcaagtgattgtgatgcagaaaagccatatagcagtgtccagcaattgttcatcaactattggctggaaggactagaaatacctactccatctgactccaattagattagcaacagtcaagtaaaaagctgaaaagcctccaaaataactcaaattacactacctttttggtgttttaacaaatctcaccactgaaaagctcattcttttaacttcactaaatcctcctcttttagttacagcctcattttctttgatttggtccttagtgagccctggaaacagatcatctgttagaataggtgattatagcggaaaatggaaatgcagcgtaacaaaagaaaaacaaatcgctcctgtgcggccagccatgaagcccaagttgggtcaccctgggtggcagctggatacaacagactcagcaggcaccctgcccaaggtccactcgggtctacacctctcatcacatagcccactgttctgtgcaggatcctcctgttctttgtgaacatgtttcctggtgaagaaaagtcaaatgctacccagagatattttcaggtggcatttcctgttgtgattaaacagaattatgaaatctcaatgttttcaattcactggacttcttctagactttgtgactctatctgtgataagattctgcctggccaaagatattcactaatgctttgacccctcaatggcatggagttactgattccctaagaattatattgctatttagtcacaaaaatgttaaaatccttttcctatcatggtggttttaaaacatggcccctaattctttgacaatcctttcatcatctggaaatgggattctccatattgtgaacgtactaaaatccactgaattgtacacttacaatagtcaatttaggttatataatttttacctccatttttttttttttgagacagagtctcgctctgtccctgaggctggagtgcagtggcacaatctcggctcaccgcaagctccgcctcccgggttcatgccattctcctgcctcagcctctcgaatagctgggactacaggcgcccaccaccacgcccggcgaattttttgtatttttagtagagatggggtttcaccatcttagccaggatggtctcaatctcctgacctcatgatccacccgccttggcctcccaaagtgctgggattacaggcgtgagccactgcgcccagccacctcaattttttttttctaagtgacattctatatctccttcctttgaatctgggctccatgactgcttgacctgtagaatatggcagacacgatgctgtgatttctgagcctaagccttaagaaactggcagctgcttccatttcccatcttctaggatgcttactcttggcaaccagccaccataacatgaagaagtataagcaatccttccataggtcacccagggatgaactgaggtcctggggccagaacccccagctgagctcctagctgacagcaagcaccaacttaccagccacgtgagtgagccaccttaaaagcagatcctccggccccgtgcagatccacttcaaccaaagctgtgtggaacgaagacaagctacacccttgccaagcccagcctcaatcacagactcataagcaaaataaatgcctggagatgtttaaaccatcactaaattctatgatggtctgttatgaggcaaaaggtaactggcgcttctatataatcaagagtggctggtaaaaaacagcttcagaaaatcctctaacctggtacccatatatcacagtagattctggcaagcataatcttgagcaccgaagacttcatccatacatgttcttcacaactcaactgaatcacaaactttctaacgtgttcacaccgtatcatgtcactcaaaaccatgctacagactgaaaaagaaggcaactgactttcttgttaagaaattttaaaaggaaaaaaggagtaaaaagcaagaaagctacagagcataaaatcttggaggcattcaaataaaaattatggacagctgtcaatgtgccttcttagaaaagataatgtgcggtgacatctccccactaccctcctaccctgtcgaagcgtcagggagcctgggctcaactcctcacctccagcctctctggcaggggctcattctgcaggatcctcaacgctttggcagcagcatcgtgtttcgcagcctgtcttgtctttcctttgccattaaattgctgtcctcccacagaaagttccacttgataaagtaaaggtggaactggaaatgggtaaaagtacctagaaataaaaggaggttaggcaaattacagtctcaagttgataagtcacctatacactctctggcaaatgcaagtatttccttcatcacgatcctactcacattagtgtttgatgctaatcactcttcatcaatatatccagagatttcataaaagcttaaactggattagaattgctacacagtataagcaaagagtgtttagcaatccaaacttacatctcacaaaatacaatggcttataaattatgagtttatcacactaacctgcactgacaaaatctaaaatgaattaggctttggctgagacaaaaacttggcttgctctgccttctcaaaccttagctttaaatttgcatgtctccaataggaggctgggaattttaatgcacaagtctttcaaaaggaccctcatttcaagaaatcccaataagctgtagcctacctagcagaacccagtttcttatccatttccctagcagaacccagtttcttatccatttcatagcttatatttttaaaatgactatcccccaacagagagcagggaaatgaagaattccattttgctcatcatctatccactaatgtcttttttttttttttttttttgtgagatggagtttctcttgttgcccaggctggagtgcagtggtgcgatctcggctcactgcaacctccgcttcctgggttcaagcgattctcctgcctcagcctcccgagtagctgggattacaggcacctgccaccatgcctgtatttttagtatttttagtagagacagggtttcaccatgttggccaggctggtctcaaactcctgacctcatgatccgcctgccttggcctcccaaagagctgggattacaggcgtgagccaccacacctggcctccactaatgtcttattactgccagcagaagatttttaatccatggcattttcaggtttcaattaatattttattgcaccaaagctatttacaaaacgcacaagttcaaaagtcaaaaagtacccaataatcaggtaatctacaaatgctgggaatcattgtcttgcaggaatcatgatgctatgggaatcatgtttaaatatgattcagttacacaaagcagttacaagggttatctttagccaggctgcttgagggcacaagccacactgccagcaagaaatatgctcaggccctacccaagagcagtagttaaagaagcacaaaggagccgggcgtggtggctcatgcctgtaatcccagcactttgggaggccgaggtgggcggatcatgaggtcaggagattgagactatcctggctaacaaggtgaaaccccgtctctactaaaaatacaaaaaattagccgggtgtggtggcaggcgcctgtagtcccagctacttgggaggctgaggcaggagaatagcatgaacccgggaggcagagcttgcagtgagccgagatcatgccactgcactccagcctgggcaacagagcgagactccgtctcagaaaaaaaaaaaaaaaaagaagcacaaagggccgggtgtggtggctcacactttaatcctagcactgcgggaggccaagacaggaggactccttgagcccagaagttcaagaccagtctgggcaacatacggagaccctgtctcaatgaattaaaaaaaaaaaaaagaggcgcagccaggtgtggtggctcacgcctgtaatcccagcactttgggaggccaaggtgggcagatcatctgaggtccggagttcaagaccaccccagccaacatggcaaaaccccgtctctactaaaaaatacaaaaaaaaatcagccaggcgtggtggcaggtgcctgtaatcccagctattcgggaggctgagacagcctcctcacttgaacccaggaggcagaggatacagtgagccgagactgcaccactgcactccagcctgggtgacagagcaagactctgtctcaaaaaaaaaaaaaaaaaaaaaaaaaaaaaaaagaaagaaagaaaaaaaagaaaaggcgggggaggggcacaaaggcacaagagtaattaagaccaacttcaacacttggcaggcccaaaccaaatcattactccctccacaatctagaggtactggtttatgtaaaagatcagacacgttttctcctgtattttacaaaaaaaaaaaaaaaaaaacacatacctcgggggataagcacctcctctcatgttgtagttataggtggactgcatccgagagtaagggtcaacaggcttatacattggtttttttccaagtttcatgcacagtgcatttagttctacagtaggggttatgctttctgcaagaaagaatcgacaaagaactgtttttttctggtatgagaatgatactcactaaaataaaatgtaatagcatgctttctgctaattggattcatgatactttacataaaaggacctgggtggctcactgctaggcatcagacaaggaaatccaagaatatgctgtgatttctagatatttatacacagtcgacagcacaaaatctactctgagggttaccagaggagccacaatttaacccaagacattatcagtgaaagctatatggtacagctgtcagaaataagttccaaaacacatcaaatttcacgattaaaaaatcccatgtaaatgtccaaattgttttactgtttgagaatacttaatcaatataaccttggttgtactgatttacaggattattggcttgcactcagaagtatgtccgtacacagtattgaacgatgcatttattacattactaactggatgcaaagcactgtgctaagcttaagaaacacaattcctggccaggcgtggtggctcacgcctgtaatcccagcactttgggaggccaaggcaggaggatcacaaggtcagggtatcgagaccatcttggctaacatggtgaaaccctatctctactaaaaaatacaaaaaattagccaggcatggtggcgggtgcctgcagtcccagctactcaggaggctgaggcagaagaatggtgtgaacctgggaggcggaccttgcagtgagggtggctcacacctgtaatcccagcactttggaaggccgaggcgggtggatcacctgaggtcaggagttcgagaccagcctggctaacacggtgaaaccccgtttctactaaaaatacaaaaaattagccaggcatggtggcgcatgcctgtaatcccatctactcaggaggctgaggcaggagaatcgcctgaacccaggaagcagaggttgcagtgagtcgagattgcgtcactgtactccagatgaggaaacaagagcaaaactctgtcttaaaaaaaaaaaagaaacacaattcctgccccagaggagttcaaaaaacacaaagcacactcaaagagttacaatacaacatgatgtgcaacttaaaggtgaaaaatcagtgaggaggtggcaacccaattctcttcacagaagtcacacaaggcccacaaaatattcaggtatttccattcttgacatttctaatgaatttgacctgtggtcatacttgctacgaaaatgagttccattttcatacacaacaagttatctcaaaattatcaacttcagaaaatacatgctattcattttccaatttttttttctttcagttcatccaatccataaacctttaaaaaccatttaaaaagaaaaccagcctggaaagattagtgtcagtgcacaatatttaaaaacaacactttcatatcaaaaacagaacactagaaatggcaaaatctaaatgcacataaaaatccactttaaaatgcctctttaggatgtatatagagagaaataaaaaagacctgattctgtactataactggttcaactaaatttaatgcatgaatcaaatctataagaatatctttggggtttgcacagagggccacatgaattacagatctctctcttccttgcattagaattatattttttacaaaattcatataattgcattttaagtacagtctgaatcattttaagagcagctctgatccacagaatttgtctgcaatagagaataaacatgaagaaagtatactgcaaagaaatcaaaagtaacaagaaagatgtgactggtaacttcccagattccttcctacatacgaagacctgggatgacttcatgcatgtgagggggtctctgctaaaacagccattaatgacacagcctccaggtcactgatccccaacccttcaccagccatgccttcttgattagtatgctccctgaatgggctccttgtctgaggagatactacctgctggcttgtatttaagtaatatttacatttttctcattctttttaataactaagagacatacaactggcaataagcacttctgaccaacaaaattacaatcaatattaccacactgacttgatgtgactctaaattaaacttatattcttgctaatctatacactcttatcaaaaatatattttcattaaacttcggaaatctttgaaattatctggtcacccgccatccttcctatgaccgcctttccagattgtcaggcgttaaggcatcatagattggaaaccactgctttacaatgaggttaaggattcctaaaaaataagcatttgtcactggtagtgtagaatctgtgctttcaaaatcaacaagttaagaaaccattcatatacatactacatggtacctctagacacacttttgaaaggtacctgtttggcccatgcataagacctggattccttccttcgctaccaaaagggctgactatgggcttaggaaattttgttccctccaaagctttagcagcagctgtgtgtttgacctttttaataccagttcactcagctccccattgctgatttccaagtgtcagcagtactgtaaattcctagaaatgaaaagtgtgagctctcaaattcatgaaacctgacattgactgtaatatgtcacttgaaccttgaacactttctatggtcatggtttaagaggcctggtcttatcttgataattcatcctgtcatccccttcttatccttttttgttgttttttataaacaacaacaaaaaaaagagattgtgtgtgtatgcactgaaatttttttttttttttaagagacacagtctcactctgtccccaggttagagtgcagtggtgtgatcttggctcaatgcaacctccacctcctgggttcaagaaattctcctgcctcagtctcccgagtagctgggattacaggcacctgccaccatgcccggctaatttctgtacttttagtagagacagggtttcaccatgttggccaggctggtctcgaactcctgacctcaagtgatccacctgcctcagtctcccaaagtgctgggattacaggcatgacccaccacgtccagcctcaaaattctcttccaattacttctcatgaaagatattttgcaaacttgatttaaacacacagcagtacttcacacaaattaagacaatgtttgttttgatgctgcaatgtgtttgtgggctcttgtttgaaaacataaccaccctttttttcagtttttgaaatggggtcttgctctgctgtccaggctggagctcaaatggcacaatcatagctcactgcagcctcctgggttgaaataatcctcccacctcaacctcctgagtagctgggactacaggcacacaccaccatacttggctaattttttttttttatttttttgagacagtcttgctctgtcgccaggctggagtgtagtggcatgatctcagctcactgcaacctccgcctcccaggttcaagcgattctcctgcctcagcctcctgagtagctgggactacaggcatgcaccaccacgcccagctaatttttgaatttttagtagggatggggtttcaccatgttggccaggatggtcttggtctcttgaccttgtgaactgcccgccttggactctcaaagtgctgggattacaggcgtgagccaccatgcccggcccatacctgggtaattttttaatttttgcggaggcagggtctccctatgttgcctaggctggtcttaaactcctgggctccagtgatcctctcgcctcagccttccaaagtgataggatttaaggcatgagcgtttctatttttattaagttctcaaagtaattctgatgcaccccaaagatttgagattcactactttggaatttaacaaatcaattgaagcggccgggtgtggtggctcacaactgtaatcccagcactttgggaggcagaggcgggcagatcacctgaggtcaggagttcaagacccgcctggccaacatggtgagaccctgcctctactaaaaatacaaaaattagccacgtgtggtagtacgtgtctgtaatcccagctactcaggaggctgaggcaagagaatcacttgaacccgggaggttgcggttgcagtgagccgagaacacgctatggcactccagcctgggtgatgacagagtaaaactccgtctcaaaaaaagaaaaaattaattgaagcttttattcttctgatgtaatcactgaatatcactttatctcacttacaaataatttacaagggaaacctggatttcagtatgtctaggtcatttaaatttggtgccttaaggggtgaggcaacttgccttcatagctgatttttcttgtaggtcttacttttaggattccctcagtgcacggcttccactaaaggaaaaaaacaaagaatcctttattggccaggtgcagtggctcatgcctgtaatcctagcactttgggaggccaaggcaggcagatcacttgaggtcaggagttcgagaccagcctggcctacatagtgaaaccccatctctactaaaaatgcaaaaattagccaggcgtggtggcatgcacctgtaattccagctacttgggtagctgaggcaggagaatcacttgaacccgggaggcagaggttgcagtgagccaagattgcaccactgcactccagtatgggcaacagagactccatttcaaaataaaaaaaagccgggcgcggtggctcatgcctgtaatcccagcagatcgcgccactgcactccagcctgggccacagaatgagactccatctcaaaaataaataaataaataaataaataatcctttaccccccttgacacttcacacatcaggacatcaggggtctcctttattatatgttctgcagtccatcaggctactcatttaagtacaaacaacagcatgaactcaaaaccctggcaggcaggaaggtcaaatggcagaagcctgcaacgcagtacaatccctgggtcatcttggtgattgtctcatggataaatgctgaaggggaaaaagctaaaaaaaaaaaaacacacaaagttattctcgtgaaccgtcttgcctttctctaggactttccccatccggtgctacctgccactctgctgcattctgttggtgtagcaaggctagaatcttggttttgatagaaccaaaagtataccacatctcttgatttttcaaataatctaaatcacccaagagagaacaacttctcctctttgaacaacttgtgggtaaaaagaaaatatgcggttagagatgaacacacagccaaactacctaaattattaaaagttcaagtgagaaagtgcattagccaaaatataataaaaagttaataaagggaatcccgaagttaaggtctgcaaaaaaatcctggagaggaaatacaacagttatagaaaaatgactgacttctatttttattttaattaattattttttgataaagggtctcactctgtcacccaggctggaatgcagtggtgccatctcagctcatcacagcccccacctcccaggttcaggtgattctcctgcctcagcctcctgagtagctgggactacaggtgcgcaccaccacatccagctaatttttgtgtttcttggtagatacagggtttcaccatgttggccagtctggtctcaaactcctgacctcaagtgatctgtcggccttggccttccaaagtgctgtgaatacaagcatgagccactgctcccagtccctagttgcctaaatgtgtctataaagacacatttcaaatagaattatgttttaaaacaacatttttaagctagttttgtgtgagtggtaaatactgtttttcttaaatgcttaattaaatgcttaatcctgcctcagctacccaagtagccagaattacagctaccatttctcaagcatttactaggcattgtgctccacaggttaacatatatgctctcatttaattctcacaataaacctatttggtgggtattatccctgttttacacatgaggaaacaacgacaacaaaaaagtagtaacttgcacaagatcacacagctagtaacaagctgagactcaaacctagatgtgtctgacttcaaaggcaactgaaccgtattatgctacggtgactattcatgtttgtgccttatgttactttcagtcaaatgaaaagaaacacttgattttattcaaggcttgaggtttgcgtgtgaaggaaaatgaggcaaaatgagataaataactcatccttaattatattatctttgctgcaaggttaggatcagaaacagacagcgtcaattccttatctctcatactatatcatcttacgctacagctgcaaaagacaactccgtatctccgtgtccttagatggttgggaaaaaagttaactccagatatgcaagaattaagttccagaatgtgctgttaatacagataacaaacaagtttcaaagactgaattatttttttcctttccatgttctaaaaagactgaattcttgaataatgattagcaaattttaaaattatagtcagactttcattctctaagataaggggaatgacaaggataactgaaaccaaagacaatacaaaatactcactttgagactacatggtgaaaccccgtctctactaaaatgcaaaattagccaggcaattgcatcttcaaaccttttgcccagattgctaacaagtgaaaaaactgttttcccatcacctcttctccctgccctaaggtccttgtgcaaacaagcaggagaggagccagaagtaagctgcagacaagaggtggcccaaagctggaaaacttacgggcaatcaatcacaggtgcttgagaattgtctctgttcagaatcccaaacaaccatacactatttggagttttaaaagcaaaatatggccaggcggggtggctaacacctgtaatcccagcattttgggaggccaaggcaggcagattgtttgagcccagcaactcaaaacaagcctgggcaacatagtgagacttcatctccacaaagaattaaaaaaaaaaaaaactagctgggcgtggtggcatgcacctgaggtcccagctactcaggaggccaaggtgggaggattgcttaagcctgggaggtcgaggctgcagtgagacatgatcacaccactcactccagcctaggcggcaaagaaagactctaaaaaaactaaaacccaaatattccaaaaagcaacacatattttctttgacccattggcaaggatgaaaaaagaagcaacttcaaaaatctataatcttgtctaagtatagtttttgtttaagacaacctcatcagtttgaaaacatgtattttgaattacagcaccactttcaagagtataaaaaatagagaacattccaggtgggttataaatgcacaagcagtatggacaatatttaccttacagtgagctggaccttgctcacacaaaagcctatactcaagctggatcttgctgaaacaaactaactcattcacaagacacaactgggatttttctctatggggttcgccacatgagaaggaagtgaaaacgttaagagcactgaagtcaactagcagtatataagactactattctcctagggatatgaaaatagaggaaaaacaaatggaaggtctacaaatgtaggcagccatgatacaaaactgcaaatcattccaggagtacactcccagagaagacgcaactagggtcttttctgaaccagttgaagccaggtaatctaggagagggtgtgtcttcaaaagagagtgaagtcaggggagtaactaacccatggcaggcaagcaagatttgaaatcagatgaatcactgctattaaaaccaactggaatacaaggtcttctgagcagacactggttactgaaacagccgccagctgtaccccgcccattatttcgctaaactcaacatgccactaccatctctcaaacaacacttgtcatcttccatacagtgaaactctcattcctgggcatcctctagtcttttctccaaaggctgccatcctcagaccttatctatttctaacaattatataaataaaataaaatgatgttggtgggcaggagttttacaaagtcaataggatttggacaccagaattcattagaagaaaaagcaataaatcccagaggacggaaacagtctgtgccttttccttttaagagagtctcacatggcaaatatggggaaaataacatctctccaggactacaaaaaatcaagaatgctatctggtgaaccagtccaaggaattgtgggggtggcatggaagatgccacgcagctgagtgggagaagcaaacactctaagaacagatttataggccagacatggtggctcacgcctgtaatcccaacactttgggaggccgaggcaggcggatcacgaggtcagaagatcaaaaccatcctggctaacaaggtgaaaccccatctctactaaaaataccaaaaaaattagccgggcatggtggcgggcgcctgtagtcccagctactcaggagactgaggcaggagaatggcgtgaacccgggaggcagagcttgcagtgagccgagaccatgccactgcactccagcctgggcgacagagcgagactccgtctcaaaaaaaaaaaaaacagatttataaagtaaaggaaatgagaagacaaaggaggaaactgaaaggaaacaggcacaaggaaggggatgaaaagactttgttataaggtaactctggtatagaaatacccacatactaggctggatgtggtggctcacgcctataatcccagcactttaggaggccaaggtaggcggatcacgaggtcaagagattgaaaccatcctggccaacatggtgaaaccccatctctactaaaaatacaaaaattagctgggcatggtggcgtgtgcctatagtcccagctactcaggaggctgaggcaggagaattgcttgaacccgggaggaggaagttgcagtgagccaagattgtgccactgcactctagcccggcgacagagcgagactccatttcaaaaaaaaaaaaaaattgacactgacaccccatttatttcactggtcttgccatgttgcagggagggtgttgggaagcagaatattgtttttatttattatccccactccctttttttttctagtcagaccctgtctcctattcataagaatattggttttaggttttctttctttagccttagtttcttgtctataatatttttaggtatttttcaagtgtttaaaccttttttttttttttttttttttttgagatggaatctcgctctgttgcccagactggagtgcggtgacatgatcttggcttgctgcagcctctgcctcccaggttcaagcgattttcctgcctcaccctcccaagtagctgggaatataggcacacaccgctacacctggctaatttttgtatttttaatagagacagggtttcaccatgttggccaggctggtctcaaactccagacctcaggtgatccacctgccttggcctcccaagtgctgggattatgggcatgagccactgcaaccggcaaggtacctttagttcattttcctaattatcagatttgaatgtttctatactttttgttttgagtcagtctcagtctgttgcccaggctggagtaagacagcacgatcacagttcattgcagcctcaaacttctgggctcaagcaatcctcctgcctcagcctcccaagtagctgggacaacaggtgcacaccatcaagcccagctaatttttaaattggcctcgcagcctggcacaatgactcacacctgtaattccagcaatttgggaggccaaggcaagctgatcacttgagatcaggagttggagatgagcctgggcaacacagtgaaaccccatctctactaaaaatacaaaacagccgagcgtagtggcaggcacctgtaatcccagctactcgggaggctgaggcaggagaatcgcttgaacccaggagccagaggttgcagtgagccaagatcacaccactgcactccagcctaagcaacaaagtgagactctgtctcataaataaataaataggcatcccaaaacactgaaattacaggtgtgaaccaccttgccagccaagaaggagactttttttcttttgagacagggtctcgctctgtctcccaggctggatggaatacagtggtataattacagctcatggcagcctcgacctcctggactcaagtgaccctcctgcctcagcctctggagtagctgggaccacagctcagccaatttttgtatttttttttttgtatagatgggatttcaccatgttgcccaggctggtctccaactcctgggctcaagcaatctccccactcggcctcccaaagtactgggattacaggtgtgaaccaccacgcctggccatgacgcagaaaattttaacaagaaaataaatttgggcattgtagctcacacctataatccagctattcaggaggctgaggcaggaggatccacttgagcccaggaggttgatgctgcagtgaaccataatctcacactaccgtactccagcctaggcaatagagaccccgtgaaacaaacgagagataagaaaggaaagaagagaaaaaaaactctgcttctttattccatttctaattgatcctcattatgatttctaaactacttctggaaccttccagacttaaacttacttgttcaaaacaaaaataaaaataaataaatgtcaatgtacttttttgctttctagtaaatctggctgcccccttgcttgggataaaatcttacggacattcaaaaagaaggcttatgtagatttaagagctcttcgtcagttgtgggaattttatttatttattttttatttatttttgagacggagtcttgccttgttgcccaggctggagtgcagtgccatgatctcagctcactacaacctctgcctcctgggttcaagtgattcttctatatcagcctcccgaatagctgggactacaggcacgcaccaccatgcccagctattttttgtatttttagtagagacggagtctcaccatattggccaggctggtctcgaactcatgacctcgtgatctgcccgccttggcctcccaaagtgctgggattacaggcgtgagccaccgcgcccggcctattttttctttttttgagacagtgtctccctcttgcccaggctggagtgaagtggcacagtctcagctcactgcaacctccacctccagggttcaggcaattatcctgcctcagcctcctgagtagctgttatgggcgtgcatcaccaagcccagctagtttgtgtattttttgtagaggcagggtttcaccatgttggccaggctggtctcaaactcctgacctctgctgatccacctgcctcaacctcccaaagtgctgggattacaggcgtgagccacggcacctggcttgttctgggaaataattttaaatgcagaattatcccatacaacgatgaatatccaaggtggtatttactgctcaattctttctgccagccaccgctctttaacagatgaggctttatagtgtgagtagttttcagctttcaattctctttctcacaacctacaatcgtctgtcaactgaggcccctgtcaaccccttacacaaccagtgttctatatctgggataaagaagtgtgggtggtgatactttcttttgctttttgaaggtaaatgtgagagctccctaaatctgcaacctatcagatcagaaaacagggtaagaaaacatttgaaatagaagacacttggattcatatgcttacctgcagctgcactggtggatgtaatagatgcagagggtaaagcagagttttgaatgggtctacctgcattttcagagggcagagagctagtagtagaaggaatactcatcaaaggctgtgagagaagagactggttcttgttcagtatttggctccctgagagagcagcagatgggttctgaacttgcacttgaacttgagacatggtcactttcaacaaaagtgaacaaatgcaggtaaacagctttcagtgcaggttaattcagtgctatgaagtctaaagttctacctaaaagttgtaagggaaagaaaataaaaaggtaaattatagaggagatatgtaattgccaatattcagtcaaaatggtgtcacctactgacttatgaaaatagctccatttagcatgtagctatgttgatttattcgaaatatgtttctccttggtatacagtaagtttcttggccttgtgactttcccacagtgttttttaagtgatttacaatacctgtgtgctctgcatattcattatacaaagagaatcagtagggtataatatttattggtgagtattaagaattgcaaactatagcttacattcaaaaatgcaaatttgaaagtatggagaggtttccatagtaattggggcacagtaaggtttctttctggtctcaaaattacaagaaactgaaagcaaactaggtttatcataccaggaacaggtgaatgtgaacactgcttcctcttaaggaccaaggctcagactgacaaccttagggccttaagttgacagaaggaaggtaggatacttctgctgtttctttttctttatggtgatgagagatgtattgttttcctaaaaggcttgtttgaggtctcatttaattatagaacccaaacaaggaaactatcacaaccctacccaggctcacagatcctgagaagtgatgtgagtaacaaagaccatactagagaatttatactattaaaagcaaaagtggagatgaagaagacaggaatggattttagactggcaattttactggtgtggttgggtgggggagcactggagcttgtttacttcatattgtaaattaagagaataatgaaggcattacttctaaatacattaaatttcttcacgagacaaaaataaggacagttgtgttcattttcatggccatcctttaaaagctgaaaatgtttttaatgagtcaaagtacttaaaaataaccagtggcaacaaagaacagaaatgacaggtctctcaggaaatagccaaccaatgcagaaaccagcaaaccaactaattagaagttctattataaagaaacagttactttaattttttttaagtatcaaaatgatttttaaagctggtcctcaagaaagagatgaatgaccagagcaattaagctacttgaggagtcctaacacattctctcttactgagagcaaaaaggactgcaaaactcaaaagaaactcaagcgaaatgtgactctggatagcagaggcataagtattaccttattcaacaaaattccccaagagtgcagttgttcctttttactttcagaatcagaacaaaataacagaggcgttccattgaagatctacataatggtcttagaagacaagtcgccagtgtcaagaaacaagtccagaaccattcagaagtcagctatgaccttatttcattgggttttttttccgtcagctgctaaaatagaaacacttttttcctcctctcttcccctctcttcatttattcactcactcctccttttcctgctttttgtaaactatcttgagagcactttttaaaacaaaaaagtcacttgtgtatgtacgacttcacaacaccaaccacaggtctcaaggtcaaaaaatgagctaggagtaaagtatctgctccagaatctacccccatcccagaaagagcaacccaactgtgtcctgagtggctcttagagtttaagactctgaatgaatgcctaaatttagaaagggtgtggaccaagggatttttggttaatgttctctaaagcaggctgactgccaggatttcaagtcagtgataaatttttaattttttttttttttttccgagacagagctttgtcgcccaggctggagtgcagtgttgcaaacttagctcactgcaacctctgcctcctgggctcaagcaattttcctgcctcagtctcccaagtagctaggattacaggcatgagccaccatgcctggctagtttttgtatttttagcagagacagcatttcgccaggttggccaggctgctctcaaactcctgacctcaggtgatctgcccacttcagcctcccaaagtcctgggattacaagtgtgaggcaccgcactctgctcaagtcagtcataaatatgtaagttttctagaagctgagaaaggaataggctttttaaattaagactgcctcaaaaatgttacccttaaattcacttaaaggacttaacatctaacagttggttgaaatatgtagttcaaaacaaaacaaaccaaaaaaaaaaagttaaactctccaaataagactaggtaaatttaaatttccaacatgataaatatgaaaatgcaacaaacaatactcacaaattattagtcacctgctagtttaaaatttttatgtgtcttatttaagcctgaacagagcatctaaggtagtgattctcaaaagggagcaattttgttcccccaggagacatctgccaatgtctggagacattttttggttgtcacaaccagtgtgcagaatggggaacctactgatatttagtggatagaggagccagggatactgttacaagcacacatatactaacccacacaatacaatcttactaatgtaacaagtagcttatattcttagacaggaaaagaaaatcccctttctatctcgaaaggccctaaaaaatagatgctaattttttttttttttttgagacagtctcgctctgttgcctagggtggagtgcagtggtgtgatctccgctcactgcaaactccgccttctgggttcaagcgattttcctgccttagtctcccgagtacttaggattacaggcgtgtaccaccacacccggctaattttgtatttttagtagagacagcgtttcaccatgctggccaggctgatcttgaactcctgatctcaagtgatcctcctgcctcagcctccctaagtgctaggattacaggcatgagccactgcgcctggcctgatgctaatgttttagcacccaaacagatgctcctctcccaaagagaagccggaacagacatcacagtgatgaatgggggaaaatatatcatttgcccacataactcaaggaacaaattaagtttttcattactgatatagatatagttcatagcagccttcaaggaactgtggaactttggaaatagaacttctgtgtaaattctaaacctgttgctcaacagtactgtcctgaagactaagtccttaaatgcaaataagtcttttcctttaaacctgtctttaaggattgttttccaccaggtaaattaaggacttgagagatcaaaatgttttgttagagtcttcttagagacaaacactattttatacacagtaaaattaggttgagaagtttgaaacgcaaagattcttcagatctcgctggtgctggaaaacacctcttactgtgaattgtgttgtgctgccattttcctgcctttctgcctcccacacagatgaggacctttcatctcctggttctttccctatttgaagggctttagacaccagatcaacaaaacatactcatcttaggctcaagccctaattttacatagcatacataagcaccataatacaagctgcaaaatgatagagttataggtgtttcttttaaaagattccttaattccatgtcctcctggttcttaagattggcttggtaacacaaaaatcttctcataaaaacagaatcttgctttggctggcagttaccgttttacaagtgccaaatagtttctatgggttgtggtgaaggagaatctgggcacatgagcgctacgaaagttttttttaaattatacatgatgtactaaaaagtggtcacaaaatgtgtattcagcactcagcagtgaacctaccaagactagaccatactgagcacagtccgagtgatttaatatacaagaaggcagacccttctagaaatggtttacagaactatctgcaatcgtgcttagtcttttaattatcttgtgctactaatacatggttagtcttatccactttcaacttacagactgttaaatctttgtactatgaaatacttaagcaattatggaaaaacattttttttctggagacagtctcactctgtcgtccaggttggagtgcagtggcacgatcttggctcaccgtaacctctgcctcccaggttcaagtgattctcctgtgtcagcctcccgagtagcgggaactacaggtgtgtaccaccacacctggctaattattttgtgtttttagtagaaatggggtttcaccatgttggtcaggctggtctttaactcctggcctcaagtgatccgcctgtcttggcctcaacaaagtgctgggattatagacatgagccaccgtgcccagccagaaaaacatttttaataagtaatttttaaaccggattaacacaacttataatgcagtagctatacttttgtttaatcaacatatcagtctccttcataataagtgatatttccaaacaagatgtgtctgggaaaaaaaaaaaaaaaaagaaggaaagaagtcatcccaattctggagaagcctccttttcagatcatcacaaacatttcactaaatgtctccccttgcaagtcctttggtaaatctgatgtaagatggatatacagatacaaaggagcactcctgtgcctcgctgttataaagcaatagcaattctaaaatatattcactcaatagtctacaaaaacttattaagcatctattacatgtgaacccataaatggcagattgcacattcttaaatgctggaaaggatctgtgtgttaaactcttcctcaaagacacaagacgacatctttcagcaatcacatgtaaatctattattctgttctctttagtttgttgagaggctccactcccagagaaacttggtcaattaaaaaacatcaaggaataaaccactttttctacaaaataaagtccttttcaatagcctttaaatacacctaaaatacccacatcattccttataccagttatttatttatttatttttattgagacggagtctcgctctgttgcccaggctggagtgcagtggcacgatctcagctcactgcaagttccgcctgccaggttcacaccattctcctgcctcagcctctccaagtagctgggactacaggtgcccgccaccacgcccggctaattttttttttgtatttttagtagagacggggtttcaccgtggtctctatctcctgaccttgtgatccgcctgcctcggcctcccgaagtgctgggattacaagcgtgagccaccgcacccagcctataccagttatttctaagattcttttctgacacatctttcttgctgcaatatggttgaatgttttctgaaagtaaactcactctccaccattacttctccctcccagccccccaaaatagtaattcattgactccaaacattatccaaatacctgcaggcagggcagacgctagtacagaagcatgtcaatcactatcgtcttataggatcatttccaaaatgaccgctttaaggtcaatgtcaagcaaataatgtccaatagcaggcctatatatactaaatcacccaataataaaacgtttttgaaaagaaatatgaccaaactactttaaaaaaaaaaaaaaaaagaaacaaatcactaagtacctgatgctcaagacaaagacagagattagccctgaggaggcacactcacttgcaagacagtaaaattaaccaaaaataatgcctggaaacaacccaggctgttcaggatctttgcacttgcaatacaagtgagactgaatgtggtccctgtctcacacttggcccaatgccatgggcaatggaggactttctttccacacaaatgtaacagttgggaggtcagatggtctgcttaaagaaacacttcctaaaagagattttcattattttcatcctagaaaacccatcacaccatgctaaagtgaaaaacaatttacctctatagcctaaaaaactataagccttattttcttttctagttttaaaactttatcaagcttccgtctctccttctctaggagacattctcaaaaataacaaaattcaagcacatacatttgtaaacagtttttaatctaaacttatacaaacatagaaaacttttaacacaataaaaatgaatacctgttcatgatctgctggagacttttaaaagtagttctgtgtgatattttcttgactatgaaggggcttggttcaacataatggttaacaggcttttcctttcagaaaagggaaactgtaatctgtaaccatgtgccatctacctagaaacacgactgcatttaccaccatcttcatgcaaaacagaccagtgccaagactcagtttctaagaaaccacccttgctgctaagtagcaaccaacaatgttaaatcagatcaaacttctgagatgtagctttcaattccactcccagctcttggcaatccactcccctgtgcctcagtttccccaaaacactttataataggatatttgacaaagcctcacttgtagcaatcactgagtcaaaacactaaaggaatcctgaggcatgataatacattttttttttttttgagatggagtctcgctgtgttgcccaggctagagtgcagtgaaacaatctcggctcactgcaagctctgcctcccgggttcacgccattctcccgccccccaacacctggctaatgttttttgtatttttagtaaagacggggtttcaccgtgttagccaggagggtctcgatctcctgacctcttgatccgcccaccttggcctcccaaagtgctgggattacaggcgtgagccactgcgcccagccgataatacaattctttaaaaagaaaagcattaggccgggcacagtggctcacgcctgtaatcccaacactttgggaggccaaggtgggtggatcacctcatgtcaggagttcgagaccagcctgaccaacacggtgaaaccctgtctctactaaaaatacaaaattagccaggtgtggtggcacacgcctgtaatcccagctacttgggaggctgaggcaggagaactgcttgaacccaggaggccgaggtgagccaacatggcgccattgcactccaacctgggcaacaagagcgaaactccgtttcagaaagaaagaaaagaaaagcattatacaaatccagtgtggtgagtttaaaaccattcactgagctttgtacaacttcaataatttccttatgcttccatttcctcatcctcaaagtaggttaacttgtctactaattactacctcagagatatggtacagcaatgtgctttcagcttctagagggaaagtgttaaaagcaggaagcagtattaacccacatagtgtattttgcattgccctgacaaaagaccagaaaatcttgaacactcttagaaaactccttttttatctgaatgttcacaagctgctagtggtcaacgaagcttgattcgtaaccctatctcacaatagaaaacaatgctaaattcgttctatgagtttgaaaatcatgtttaacataaacaatctgagaaatcaaagggtttttttaaaaaaagcaaactacaaaagatactatgaccaagaagcttattgagccagtcatgtttaatgacagcttcagtcatcaattctcatgtctctatatttaaagaacataggctttacattcttgccaataacttttcctgtacttactttctaattaaatcaagagtaaagatgaaattcaaactgcataaaatttgtttctctaatattatagccagaagtaaaaatcattctccacacaactcattaaagaattcaaaagtaccactgattatcaacaggccagaaattataaagccaaattatatgtaccttttttaaaaagagggcgttccaggaacaatgttgtctttgttcagttctgagaggttaagtggttaataaactctggaaaataaaaaataataataatttagtagggtaggtcttttctctgaaactgaagacatactgctcaagttttggggaaacctataatttacaagtagggaagactgaaggcatgacgtcatggtttgaggcagcatgcagtagagtcttcaaaagacacaagcggccagacatggtggctcatggcctgtaatcccaacactttgggaggccgaggcgggcagaccacctgagacccggagttcaagaccagcctggccaacatgatgaaaccccatctctactaaaaatacaaaaattaggctgggcatggtggctcatgcctgtaatcccagcactttggaaggccgaggtgggaaattacgaggttaagagattgagactgccaggcatggtggcgcacgcctgtaatcccagcactttgggaggccgaggcgggtggatcacgaggtcaggagatcgagaccatcctggctaacacggtgaaactccgtctctactaaatgtacaaaaaattagccaggcgtgatggcgggggcctgtagtcccagctacttgggaggctgaggcagaatggtgtgaacccgggagacggagcttgcagtgagcagagatcgcaccactgcactccagcctgggtgacagagtgagactccgtcacaaaaaaaaaaaaaaaaagagattgagaccaccctggccaacatggggaaacccatctctactaaaaatacaaaaattagctgggcgtgatggcacacctgtagtcccagctacttggcaggctgaagcaggagaatcgcttgaacctgggaggtggaggttgcagtgactcaggatcgcgccactgcactccagcctggcaaaagagcgagactccgtctcaaagaaaataaataaataatacaaaaattagccaggcatggtggcgcaggcctgtaatcccagctacttgggaggctgtggcacaaaaatggcttgaatgcaggaggcagaggttgcagtgagccaagatcgcaccactgccctccagcctgggccacagagtgagactcctctgggaaaaaaaaaaaagacacaattgcctggaagctgggtgaagaatattttgcagagacacatttataagagacagcagaactttccttttccagtcccaattattccctgatgagagtaatatgaatatctcataatgtttaggctttgtttgttcaggtttttttttgagatggagtcttaccctgtcccccaggatggagtgcagtggcgtgatgtcggctccctgcaacctccgcctcccgggttcaagcaattctcctgcctcagactcctgagtagctggggttacaggtgcccgctaccacgcctggctaatttttttatttttatttttagtagaaatggcagggttttgccaagttgtccaggctggtctcgaacacctgacctcaggtgctccacccacctcagcctcccaaagtgctgggattacaggcatgagccaccacacccaacctcataatgccttttttttttttttttgagacggagtctcgctgtcgtccaggctggagtgcagtggcgcaatctcggctcactgcaagctccgcctccagggttcacgccattctcctgcctcagcctcccaagtagctgggactacaggcgcccgccacctcgcccggctaattttttgtatttttagtagagacggggtttcatcgtgttagccaggatggtctcgatctcctgacctcgtgatccgcccgcctcggcctcccaaagtgctgggattacaggcgtgagccaccgcgcccggcaataatgctttttaaaaggaactgtacattacatatcgtccgatcacataagactgattttcaaacctgtgttttctttccctttatacctaccactttattcgtaaatgtcgttggcatatgcttggtgacccaaatacaattttatggaaaattttaccaaaaggcattgggtacataaatagtggcatattaaattgcagaatatgaaaaaagcacattatctctaataagtccaaatcataatcatttttagaagtgaactttacattacagaatttgagtttaattctcaaattctgcggtctgatttatctagaggttcctcaacttaaatggtagttgtcagtagtaacacagaatttcttaccttgagatgcttttatacattcttacaacactaagtgtttttgcttgtttcagtttctcactgctactatggcttaacaggcaataaaaaattgctgttcattgtctgattgattccagaaataaatcatgagctctagtttattttctggtattttaacagctcaggttcttttcatagatagtatattatactaacaactttccagtctagagctcagttgttctaatatctcagctattcaaagactggcatgaatgggaactgaaaaaggcctctgagcagcccaaataccaaagaccttctaacatagcccatgccttttaccaataggggcctcacctgagccaagaagttttctatgttgaacaatttttgtaagtttgggtgtctagtttttgttttgtttccaaattccctatcccctattctgagaagcagggtgtctagtttttttttttttttttgagacagagtctcgctctgttgcccaggctggagtgcaatggcgtgatctccgctcactgcaacctccgcctcccgggttcaagcgattctcctgcctcagcctcccgagtagctgggattacaggtgcatgccaccatgcccggctaattttttgtatttttagtagagatgggtctcaccatgttagccaggctggtctcgatctcctgacctcgtgatccgcccacctcggcctcccaaagtgctgcgattacaggcgtgagccaccgcacctggcccagggtgttcagttttctagcccaaagcagaagtaaaaaataaaggccaggtgtgatggctcatgcttgtaaccccagcactttgggaggccgaggcaggtggatcgcttgagctcaggtgtttgagaccagcctgggcaacatggcaagaccctgtctctattaaaataaaatttaaaaatttaagggccgggcatgtggactcacgcctataatcccagcactttgggaggccgagggtggcagatcccgaagtcaggagatcgagaccatcctggctaacacagtgaaaccccgtctctactaaaaatacaaaataattagccaggcatggtggcgggcgcctgtagtctcagctactcgggaggctgaggcaggagactggcatgaattcaggaggcggagcttgcagtgagccgagatcacaccactgcactccagcctggatgacagagtgagactccgtctcaaaaacaaaaaaaaaattttaaaacacacataaaaaaagctaaatataagaacggaaaaaggagctgttagagtcagacataaagacaatgctaaaaaataaccatcatcaacttagcaaagaaagaagagagagagagaggggagaaatacagcagtcatttggatctcaaatacttttacacagtgatagctgagattcatacaaacattcatgttttggccaggtgtggtggctcacgcctgtaatcccaacactttgggaggccaagacagaactgcttgagcccaggagttcaaggccagcctaggaaacagaggaagaccccatctctccaaaaagtttaaaactagctaggcatgatggcatgcacctgtagtctcagctacttggaaggctgagatgggaggactgcttgagaccagaagattgaggctgcagtgagccctgagtgcaccactgcactccagcctaggcaatgaagcaagactccatctcaaaaaaccaacaaaaatgcacatttccatatgcaaatctattttttgaaatcctccaatttcaaaagataatccaaagccatcatgatcattatcaatatatctatatagtgcacacttaccactgcaattttccccagtcaagaatgcatactaaaccaggcaccgtggctcaggcctgtaatcccagcactttgggaggccaaggtgggccaatcacctgaagtcaggagtttgaggctaggctggccaacatggtgaaatcccatctctactaaaaatacaaaaattaggccggcgcagtgactcacacctgtaatcccaacactttgggaggccaaggcaggtggatcacctgagatcaggagttcaagatcagcctggctaacatggtgaaacactgtctctactaaaaataaaaaaaaattagtctggcatggtggcacatgcctgtaatcccagctacttgggaggctgaggctgaacaatcacttgaacccgggaggcagaggttgcagtgaactgagattgggtcactgcactccagcctgagtaacagagcgagactctgcttcaaaaataaaataaaataaaaatataaaaattagccaggcatggccgggcgcggtggctcacgcctgtaatcccagcactttgggaggccaaggcgagtggatcacaaggtcaggagatcaaaatcatcctggctaacacggtgaaacaccgtctccactaaaaaaaaaaaaaaaaaaacaactagctgggcatggtggcgggcacctgtagtcccagctactccagaggctgaggcaggacaatggcgtgaacccgggaggcagagcttgcagtgagtcaagatcgcgccactgcactccagcctgggcgatagagcaagactccatctaaaaaaaaaaaaaaaaaattagccaggcatggtggtacgcacctgtaatctcagcttatcgggaggctgaagtgggaaaatcgcttgaacctgggaggtggaggttgcagtgagccgagatcacgccactgcactccagcctgggcgacaagagcaaaactccacctcaaaaaaaaaaaaaagaagataaaaagtagcaaattatagaaagtcccttatgcaaaagaaagcttatttcacttttattcttttttatgtttggtgcttgaataaattctcaactaaaaggaaaattactatacagaagtagtcacttgctaaacattacaggttgcaaaggtttactcaatgacaaaccaaaaggaaacttatttgcctaactatatttgactgtcatctaggtaaagggtcatggagctttcatgagcaggttggttcaattgtgcaacaaggaaaataagcttccaagcataatgagacttattattacatataaattgttctttctgacagaggaaaggactgcctagcattctgcataaaatcacaatggcttcagcagacaatggccctatttgaatcagggtggaatctgcaagggtagaaaattcatgcctcagttaattgtaatctatagaaggcatggatttcaaaacagcaaagataggagagaatcagacaagatctagttagatcctaaagctcatctctgaagggagctaatatagtgacaatgtaagcagcattatctgctcacttcatgccaaggggtatttccaacacctattagtgattaatgagacatgctatgtcattacagactacagggtagcctcagttgaggttaaacacaaaatggaacttcagacaccatttcactaaaagctcacatccaaaggcagatttaatttcactgatccagcctttcaagactaaccataagagaagactgcccaggtggaataccaaagaagcttctgattcagatcaccgtttcaaacaaaagtaaaacaaaattgttcaggaagcagttcaattccaaacaggaagctgtactaaatactcccaacagtattagccacaagagggatgttagaaagggctaggaagcaaagaggacaaccagcacctatcctataaagttaattggaagcttagttaactcatttccactaaagcagaatgttagaattcagaagaaatgaatttttttttttagcaacaacctggactacagttctttttttttttttccccccctggatacagagtcttgctctgttgcccaggctgaagtgcagcggcacgatgtcaggtcactgcaaactccacctcccgggttcaagccattctcctgcctcagcccccggggtagctgggattacaggcacgtaccaccacacccagctaatttttgtatttttagtagagatggggtttcaccatgttggccaggctggtctcgaactcctgacctcaggtgatgcgcctgccttggcctcccaaagtgacggaattacaggcgtgggccaccatgccagcaatttttaacaaacctgatgacacacgatagcagtaatttaggagctggcctcctttaacacaaaggttaataagacagcccctccccacacacaaacctgtggatcagctttaagttttagcttaatttgacataacaaataaaagtaaactggaaagctatttcaagggtccatctaaaagactattacttaaccagactttctttcaaattgatctagggttctaatgagcaaaattcatcctagctgctgcggtggggagagtcaggggagggccaccagtgacaagcagaatcaattatcctaaacaaaaagcacctaagcataatttagagacaaagcatggttcagtggaaagaacactgactttggagccagaccagcctgtgctctagaactaatacttggtgcctcaggactctgagccagttatctggcccctcggaagcgcatcagcatcctcagcaattattatgagctttacgctgcaaagatgtttatgagtattagaaatacaacataaagggtctaagaaacccttttctttggttcaaggaaagagctaaatgaactgcaacttttatattattaggtaaattcaacctgaccttttaattccttttctgcataaaataactttcaccctgtaattctaacctggcacatggtaagagctcaatagcagtaaatattattatccagcaaattcactaaacctgtccttacacataaacatctataaaacttacagcaacactccacttgtaaaaaattttaaataggatcagagaatatgctgactaaaaccaacccactcactgagcaaccagttctgtagctacatcaagtataggggcaaggccgggaacagtggctcaagcctgtaatcctatcactttgcgaggctaaggcaggcggattgcctgagctcaggagttcgagaccagcctaggcaacatggcaaaaccccatctctgctaaaaatacaaaaaattagccgggcgtggtggtgctcaattgtagtctcagctactcgggaggctaaggcaggagaattgcttgaacccaggaggtggaggttgcagtgagccgagatgatacctctgcattccagcctgggcaacagagcaagactatctcaacaaaaaaaaaaaaaaaaaaaaaaaaaaaaaaagcagaggcaatctaatgaaggtttaaccctcagcaatcatgttcattcaggggaaaagaccccaatgtatttaaatagattttcttagcctttattgtctgggagacatgacacaaaatttctatcataataaaatggccagttttgcttccattactgttataaacccacatagtcatcacacttctttcccaaattagattccagattaaacagatgccagatgggttacagatttgatattcagaagactaatttttaatcgaaagcaaacactttctcaaatagatttttccacttttgcttccagtaaatatactttgagggagttccctgagtctacttctttaacaaataaacatatgtaatcccagaaaatatacagcaattaacagcctgcagaaatttttctctacttccatttatctggtgacataaatcactgttacatcaaccttattcaccagtatgggaatgtaaacacttaaaaaacaaattaagctatttgcagtaattcccattttaccactttaaaaatattacttttctctgcagtaaggttttctagttcagagcattaagctgtcaacaagacagatatccaagcccatccatcccgtggcatttgataagatcaacacagctatatatttataatcctattatctccttagcaggtgagaacaatggatttggccaacattattcaagcttcataatactgtatggtaaaatgttcatgacaaagagcagaaggtatgccgggcacagtggctcacgcctgtaatcccagcacttcgggaggccgaggtgggcggatcacaaggtcaggagatcgagaccattctagctaacacggtgaaaccccatctctactaaaaacacaaaaaaattagccaggcatggtggcgggcacctgtagtcccagctactcgagaggctgaggcaggagaatggcatgaacccaggaggtggagcttgcagtgagccgagatcacaccactgcactccagcctgggtaacagagccagactccgtctcaaaaaaaaaaaaaaaaatagtagacggtgttcagcaccatgaaacagggaggcaaaaatagaaagtagatggtatctaaagagatgtacaataaaacttcataaactttgttatatgtttgaaatttttcataataaaatggtgggggtaaataaccatagcaactaacatgtcctctcatagttcaactgataactggcaatttatattttttggaacagcacaaatggtatacagccttgactctggtgaagttttatttaaagaaaagctcatgtagaaaattacacgagaagcatttcaaccacaaatgtctccatcaccagaagtcaatgtaaaataacctgttataggtctagtgtgaaacaaatctgtcataaaattctctaaacatttttgaaagctctaaaatcccattctgagagaaaagcaactccaaagctcttatttgagaggggaggaatttatatttcctcaaattgaacaattctgtgtcactgggtatcacatcaaataagaagatccaatttagaggctcatgaaaacaaggcctctgcctataatcccagctactaaggaggctgaggtgggaagatgacttgagctcaggagttcaagaccagcctgggcgacaaactctgggattgacttgtggaatcccacaaaaagatacccttttcatgaaagtttcatctttatactgaattacactcttactcaatccagtaaaaaggctcaaagaaagttgccccacaaactgagactaccttgtggtattggggagagagactggatgaagcagtatccattttgataacacccagaatgatatcaatgatctggactttagaatggggatggaggagagttccatgagtcatggccatttctaaacttaaaatacagtaaatcctctcttaacataaggggtaggttcttggaaactgagacttccgactaacacacgcttattgatacaaacaagagttaggttctagggcatatttctcatcagaaaaatatcaccaaacttttaaataaagaccaaacacttcgaatattaaacactgaaataaatgtgaagtatacatgccttttttttttttttgagaagtacttttgctcttgttgccccggctggagtgcaatggcacgataaccgctcactgcaacctctgcttcccaggttcaagcaactctcctgcctcagcctcctgagtagctgggattacaggtgcccgccacccagcccggctaattttttttatttttagtagagacagggtttcgccatgctggccaggctggtctccaactcctgacctcaggtgatctgcccacctcagcctccaaaagtgctgggattacaggcatggggttgcagtaagccgagactgcaccattgcactgcagcctgggtgacaagagctaaactccatctcaaaaaaaaaaatttttttttttaccacttattccagttcagggttggggtggctggagcctatctcagcagcttagggtgcaaggccggaaccagtcctggacaggacatccactgcagaaagcactcacacttacacacacagctccacacaccagtgaacctcacgtgcacagctttgggatgtgggaggaaatcaagagtacccagagaaaacccatgcagggatagggagaacgtgtaaactccacagacagttttttttctcaacattatcttgaaacaacattattcaaggacctgctgtaatctgtatatacatggactttctggctgaaacctaaaagagagcaacttattctcaagaaactatatttatggtaacaattctcaatgcttaaaagttttacgttaagcttaatgggaagcactacacatttttaaaaatgtgttgtgtcctttcccagatactaaattggcgtttctttcctaaatcaattttaagaggtgtatctttccccatcttccaggtagtcataactaaaacataacatgtaacatttccactgtacctgatcaagctcaaagtacacctacaaaactcaaataacagacctaaaagctgaaaactattcacgaccagaaatttgaaagttatgcaacaaagacatttataatatttataatattcctgtcaacttccattgtaagagagatcctttagacacaagaaagaaaaacgtgaacacttatgctgtgatttcatactattcacaaaaattaaggtttcattcatatttgctaaatttgttatttggaaatagggcagacgggggcactttggaaaacaattctatgttagaagattatcttttgcttaattcttaacctaaggtaacagcagtatctttacacaactactgtaaagaaacattttaagttttcattatgaattattaactgtagtttaactttgacacaaagttatctctattaaagtgggttaaaaggcaggtctctgccaaaacaggactggggaaatctgtatttgttcgcttttcaattatagtcattaatagctcaagaatttttgcttttgtacacaataaagcagcaaggttgtattttgattttgaggagctgaaggcattggatcaagagttaattttcttcttcttttctgctgtacagaaatcatgtataaacagagaagggaagcccaacaaacaaaaatgagaactattattctactaaaagtaaattttgtgaccttaatctggggcaatctggtaaaagtcaaaatcgctaatgttgtgacacaatgtttaagatttgtttcaaaataatctagtttgtgtggggggatacaacatgaaacaaaaccgaccttggctatgagttaataattgtcaaagctaagtgagtgactaacacatggggttctccatactattcgagtttcgcatgttttccagaataaaaggtttttaaaaaatggtatttaaaataccatttccctattgaaatatgccattgtgatatggcagtattagacatgctttatactgcttgtatagttgtttgcttatgtgttttttttgttttgtttttttggagagagtctctctctgtcgcccaggcaacctccacctcccgggttcaagcgattctcctgtctcagcctcgggagtagctgggactgcaggcgcccgccaccacaccaggctcaagagatagtctccatctcctgacctcgtgatccacccgcctcggcctcccaaaagttctgggattacaggcgtgagccaccgcgcctaacctgcttatggaggcctaggagggtggatcacgaggttaggagttcgagaccagtctggccaacatggcaaaaccccgtctctacgaaaactacaaaaattaacacggcgcggtggcgggcgtctgtaatcccagctactcgggaggctgagacgggagaatcttttgaaccagggtggcagaggttgaaatgagccgaaatcgcgccactgcactccagcctgggcgacagcgtgagactgtctcaaaaaaaaaaaaaaattcaaacaaacattttaaattacaaacaatggtaagactgtcagaaaattctaggaaaatgtcaaaaacaaggaggccactttgccgcatgtgtgttaagagatgggtataaatcaaaatagtttcagttcactaaggaaatttaatgcctaaaacaatcctaagatacaggaggatcactcaggtaaacacacactccttactcatataaaattgaacacccataagttgcatttccttagagtacacctataaaactaagtacagaatttttaaaaacccagtatgttttagtaaagttgctgttctaaaaatcccacctgtcaccaggataaccgaaactgctccctctacactccaactgtatttttagtttttacctcaacaagtagcaatgcaatttacacttggtaagcacggattcctgaaacgccaaaatcaaccgggaacctgatttaactccaccacgctcttaacaatgaaagctacaagcagaagagaagtgtgaccttaaaaacttccacacagccgaagaacagtggcagaacagactgaagcacgtatcttcgcggaacagaagaaaacttccacacaagcaatactgcaacacggaggcggggcaagggcttaaaaggaaagtcagccaacagggaggggtgaatataagcaaagcttccgtgaaaaaaaacttatcgaggtgtagagcaagacaagacagacaaatttttccatctccgtacaccccccttcagagcccaacacacagcaagtgctctagataggtttgctcaactcaagggaagcttctgccagcaactttcccagaaatggaatgacaagaagaagctggatgatggcggggcggggagaaatggacaggttgctcatcctgcgggagatggtgaatatcctgcagttgcctaagcggagatggaaagaaacagcatccatcgtttacagactgtcaactacagtgtcccaattaagcgtacgcccctttcagatgttaacaactgaaaacaatgccctggctctggacatgggcacgcggaacactgcagcctctaagaaacccaaacggataggtaggtcaacttctatccactctgcccattaaattataccttcatatcacgctaataaattatgcagacggtttactgggacacgctgtgggtctggcactctgataagcgctttacacgccccatttcactgaaccttaagaggcagggacggtattagcagccccttttccaaccaagacacaaagactttttaagtgtcttgcctaacggggcagagccgggttcggcacccgttttggacacctgggccgtgctcttaaccactaagctacagacctgggccggcgacactgagaggctccagccctcggggacctgaagcagggacccccccccccccccgcctgcgccccagccccgggaataacttcggcatccccgcgcgcgccatgcgggacgaggaaaggcggccgcagcacctgtttgtggcaccggtgagggctggaggggatgggggcgcccggggccaggcctcagggcgccccgaggcgagggaacgcaagaggacccgcctcctccgggaaggccccgcgggctagagagaggcccgggagaaggcggaggggtgcgcgggcccgccgaggcctaggccccacccgccgcccacctccccaccgcggcggcgcccgcgagggccccaccaggcccggcccggcccggccgcctcacctggctgctgctccgagctcgtcccccggccggcggtcctgggcggtggcggcgaggaggggaaggaagaaggaaaaaagggagaggaagaagggacgaagggagggaagaggcggagtggccgtggaggaggcgggcgccgccgggccgggggggggaggcggtcaaaggaagcgggagccgagagagacgcggcagccgccggcgcaaacgctgaagagccgctcaggcgcccgcagcccggcaggaagtgacgggggaggggcaggcgcccgcccccggcccccgcccgcctccaggcccggccccggccccacccccacccacggtccgaaccacaagttccggctggcactgcggcggagcctgcgctcgcaaggcacgccgggggcccagcgggaggagcgccctgtcccgcctggaccgcagcggcccgtcctgagtcccggggcctgccgggagttgtagttctggtgggagtttcgcgctgcctgctggactcgaagcgggtctgggagaacccagcctaccttctttcctcctccacttcctttttccttccttgctgtcgcttcttcctcttgtcctgcctctggccttcctttctctccttcctgcagttgtttcttcctccatctgtaaatgttcattaaatgcttgccatatgcaaggcattgctccaagagctaagaatgtagtggtgaactgacaaaaatccctgccctcgtggagcttacattcttgtgtaagtaaaatacacaataaataaaattgaaaaatgtgtagtgagataaaagacaatggcccgggcgcgttggctcaggcctctaatcccggcactttgggaggccgaggcgggcggatcactaggtcaagagatcgagaccatcctggctaccacggtgaaacccccgtctctactgaaaatacaaaaaattagccgggcgtggtggcgggcgcctgtaggtaaacagctactcgggaggctgaggcaggagaatcgcttgaacccgggaggcggagattgcagtgagctgagatcgcgccgctgcactccagccttggcgacaaagagacactggtctcaaaaaaaaaaaaaaaaaaaaaaaaaaaaaaaaaaaaaaagacgagaagtgccagattactatttatttcacccagacctagataaactaagtggtttttagcagctgtattgtatgggaggttggagagagggtggccagtaaagaatcttggccaggcgcagtggctcacgcctgtaatcccggcactttgggaggccgaggtgggcggatcacctgaggtcaggagttcgagaccagcctgactaacatggtgaaaccccgtctctactagccggatgcagtggtgggcgcctgtaatcacagctacttgggaggctgaggcaggagaatctcttgaacccgggagacggaggttgcagtgagccgagatcacgccattgcactccaacctgggcaacagagtgagactctgtctcaaaaaaaaaaaaaaaaaaaaaaagaatcttgaacttctgcacactcagcgaaaattatgctcgcgttgtgagaggtccaagaaactgagaatgaatgaaggaactgcaggtgcacagagcttctctctcccgctcactctgggactgccgccccactatttaaaaataattctctctttcttaaatgtctctcaatctaataattgctcaatctctcttgccaacggaatataaattcaaaatacgagctgctgtgtctgaagaggcccctccaaacaaggctttggagccttagcgaagcctgggaggacacttgcctccttacattgcttcttgtgaagtgcaatgacactgaatttcagaacaccaaaaatagtcaaaggactttcaccgtccctttagtgcccatccaagacagtagtaagcaacattcagatattgtccagccctctgctaaaagtgatcttttctttctaacttccaagcagtgtggatcccatacctccttgggtaaaggagcagatgcagagaggtctccctaaacccaaagctgcgcacaatcagacaatctcgtcaaaggtgattttgctatcacccatagggacaaaagtggtgggtctatgacttccagtctcaattttcttccctctttcctccttccgcatcttttttgtttttttcttgagacagggtctcgctctgtcacctaactagagtgcagtggcatgagcacagctaactgcagcctcaacctcctgagctcaagaaatcctcctacctcagcctcctgagtagctgggaccacaggcatgtgccaccactcccagctaattttttaattttttatagagacagggttttactaagttgcccagggtcttactaagttactaagttgaccaggctggtctcaaattctaggctcaagcaatcctcttgcctcaatcttccaaagtactggggggattattccaggtgtgggccaccatacctgaccaggagtaggtcacctagatttgttttcttctgtttgtacctagaaactatcagtcaagttctcttccaaggtcctgaagacctcttgagtcttgctaagtaattaaggaatcatttttctttaccttgagaaaaagatggaagctgtgtgttcttggttcacaagaaactgtgagcattaagtatgttacgataaattatgtgtgttccttctcacaagataaattatgtgcatctgtactaaggaatgggaacatgcaaaactcataaaagccctgtgagatgctgaattttttttttttttttttgagacagaatctcactctgttgcccaagctgaagtgcaatggtgtgatctcggctctctgatgcaaagctcataaaagccctgtgagacatttatttttatttttaattattttttttttttgagacagagtctccctcagtcacccaggctaaagtgcagtggcgcgatctcggctcactgcaacctccacctcccgggctcaagcaattctcctgcctcagcctcccgagtagctgagactacaggcgcttgccaccatgccctgtaatttttgtgtttttagtacagacggggtttcgccatgttggccaggctggtctcgaactcctggcctcaggtgatccacccgcctcggcctcccaaggtgctgggattacaagtgtgaatgttaacctctgatgaattatctgttccactctcatagcctcttagtagaactttgcacccttataattttcaattatctgttgagtatatctattaggctagaactaagtgatcaacttccatgacagcagagactcagcctgtcttagtagtcatgatggtccctggcccataacacagtgccagggacacaatagtacatgataaatttccgtagactgctgaaaaattacagccttgcttatctctgcgcaagtccctaagaaacagggaacacctgtagggttgattggtgtatgtcagggtcacctgtggtatgtgtagcacaggagaacaaggttgagaactacttgctggcctaaataagtaattcccaagcttatttgaggtagcctgcactcctagggatatatcagaatctaagagcaacaattagaagacataaaaatataatggggccgggcgcagtggcttacacctgtaatcccagcactttgggaggccaaggcaggcggatctcttgaggtcaggagttcgagaccagcctggccaacatggtgaaaccccatcgctactaaacatacagaaattagccagccgtggtggtatgcaactttagtcccaggtactcgggcatgtgaggcaggagaatcacttgaacctgggaggcagaggtttcagtgagctgagatcacgccactgtattccagcctaggcaagagagcgagactccatctcaaaaaacaaaatgaggctgggcacggtggttcacgcctgtaatcccagcactttgggaggccgaggagggcagatcatgaggtcaggagatcgagaccatcctggctaacatggtgaaaccccatctctactaaaaatacaaaaaattagctgggcgtggtggcaggcacctgtagtcccagctactcgggaggctgaggcaggagaatggcgtgaacccaggaggcagagcttgcagtgagctgagatcgagtcactgcactgcagcctgggaaacagagcgagactccatctcaaaaaaaaaaaaaaaagaaaaaacaagagaaaaaagatataatggaagatcccatttacaaagcagtggaaaaataaaaatacctagaaataaactttacaagaaatatgcacaatctgtgtgaagaaaaaatgtttaattctgcaaaagaatacagaaaaagacttgaacaaagagaaatacaggttatggtattggctaggaaggttccatccagatcattaagatatcagttgatcaagacattgaaggacagcctggccaacgtggcaaaatcccaactctacaaaaaaagtacaaaaataattagccgggtgtggtggcatgtgcctgtggccccagctacttgggaggctgaagtgggagaatcgcgtgagcccaggaggttgaggctgcagtgagctgtgattgcaccactgcactccaggcttggagtgagaccctgactcaaaaaatacattaaaatttaaaaagacattgaatgagatcccaagaaaaataacaaacaggattttgttttggatctctatgagccatgtctaaagtcttatggaaaaattaataagaaaaataaccaagaactttctgaaaactcctgaccaaatagcaaacatactattggtaaagcattaccaattaaaatagttagatgctagtgcctgattagttccacaatcaatggaagagatatttccagatagacacaaacacatgtatgaatttaatactcagtaaaagtggtatttcaaggctgggtgcagtgactcacgcctgtaatcccagcactttgggaggccaaggtgggcggatcacttgaggtcaggagtttgagatcagcccggccaacatggtgagatcccatcgttactaaaaatagaaaaattagctgggcatggtggcaggcgcctgtaatcccagctactggggaggctgaggcacgagaatcgcttgaacccaggaagtggaggttgcagtgagccgagatcacaccactgcactgcagcctggccaacagagcaagactctgtctctaaagaaaaaaaaaaggccgggccggtagctcacacctgtaatccgagttctttgggaggccaatgccaggggatcacaaggtcaagagatagagaccatcctggcaaacatggtgaaaccccatctctactaaaaatacaaaaagtagctgggcgtgatggtgcccacctgtagtcccagctactcaggaggttgaggcaggataatcgcttgaacgcgggaggcggaggttgcactgagccaatatcataccactgcaactccagcctgggcctggcaacagcgcaagaatccgtctcaaaaaaacgggccgggcgcggtggctcacgccctgtaatcccagcactttgggaggccaaggcaggcggatcacgaggtcaggagatcaagaccatcctggcgaacacagtgaaacaacgtctctactaaaaaatccaaaaacttagccaggcgtggtggcgggtggctgtagtcccagctactcaggaggctgagtcaggagaatggcgtgaacccgggaggcggagcttgcagtgagcagagatcgccacaatgcactccactgtgggcaacagagactccatctcagaaaaaagaaaaaaaaaaaagtggtatttcaaattggtgaggaaaagatagatttcattttataaatactttgagacaacaaggtagcttctggggcagggggaattaaatgtgtacttcatattacataccagggaacataccaaattgatcaaatatttaaatagaagaaaggaaactgggctgggcactgtggctcccacctgtaatcccagcactttgagaggccagggcgggcagatcacctgagattgggacttgagagaccagcctgagaaacatggagaaaccccgtctctactaaaaatacaaaattagctgggcatggtggcgcacgcctgtaatcccagctactcaggaggctgaggcaggagaatcacttgaacctgggaggcagaggttgcagtgagccaaaatcgtgccattgcactctagccagggcaacaagagcgaaactccgtctcaaaaaaaaaaaaaaaaaagaaaagaaaaagaaaaaagaaaggaaactggccaggcatggtcacccatgtctataatcccagcactgtgggaggccaaggtgggaggattgcttgagcccaggagttcgaggctgcagagaactattattattactattattattttgagacagagtctcgctctgtcgcccagactgcagtgcagtggcacgatctcaactcactgcaacctccacctcctgggttcaagcaattcctcgtgcctcggcagcccaagtagctgggattacaggcgcacaccactacacctggcttatttttgcattttcagcagagatggggtttcactctgttggccaggctggtctccaactcctgacctcaagtgatccacccacctcagcctcccaaagtgttggaattacaggcatgagccaccctgtcagcttgtaatgagctatgatctcaccactgcactccagcctgggcaacagtgaaaccctgtgtcaaagtaaaaaaaaaaataataataacgggaaaccataaaagtaccagaagaattcctgcaagaatgtttgtatcactctgaagtggagaagactcttttaactataacacaaaattcggaatccttaaaggaaaagatcaattcattgactcaggaaaataaaaaatgtgataagaggaaatacaaagacaaatgataaactggaaaaaatttgcatctcagagaggatgatttcacaaatttcatgacatgtaaggaattactttgaatagcagaatgattaacaacccaatgaaaaatgattaaaagatagcaacaggctgggcgctgtggctcacgcctgtaatcccagcactttgggaggccgaggcaggcggatcacgaagtcaagacatgaagaccatcctggctaacacggtgaaaccccgtctccactaaaaatacaaaaaaattagccaggtgtggtggcaggtgcctgtagtcccagctactcgggaggctgaggcaagagaatggcgtgaacccgggaggcggagctttgtgagccgagatcgtgccactgcactccagcctgggcgacagagcaagactccgtctcaaaaaaaaaaaaaaaaaaaaaaaaaagatagcaacagacagttcatgggaaaggaaaaacaaatggttcttagaaataacaatgtaggctgggcgccgtggctcacgcctgtaatcccaacactttgggagcccaaggtgggcagatcacctgaggctgggaatttgataccagcctgaccaacatggaaaaaccccgtctctactaaaaatacaaaattagccaggcatggtggcacatgcctgtaattccagctacttgggaggctgaggcaggagaattgcttgcacccaggaggcggaggttgcagtgagatagcgccattgcactccagcctgggcaacaagagtgaaacttcctctcaaaaaaaaaaaaaaaaaaagaaaaaagaaaaaaaaaaaacaaagaaacaacaacgtaatggctgggccgctggctcatgcctgtaatcctggcactttgggaggccgaggcgggtggatcacttgaggtcaggagaatagcctgaacccaaggaggcggaggttgcagtgagccgagatcacaccactgcactccagcctgggcgacaaagcaagactccatctaaaaaaaaaaaagaaagaaagagaaaaaaagaggccgggcgcggtggctcacgcctgtaatcccagcacattgggaggccgaggcgggcggatcacgaggtcaggagatcaagaccatcctggctaacacagtgaaaccccgtctctactaaaaatacaaaaaattagccgggcaaggtggcgggcgcctgtagtcccagctactcgggaggctgaggccggagaatggcgtgaaccccggggggcggagcctgcagtgaactgagatcgcgccactgcactccagcctgggcgacagcgagactccgtctcaaaacaaaacaaaaaaaaaaaaaaaagaagaagaagaagaagaaaagaaagaaaagaaatagcaacatgaggccaggtgtggcagctcacgcctgtaatcccagcactttgggaggccgaggccggcagatctcctgagctcaggagtttgagaccagcgtggccaacatgacgaaataaaaatagcccggcgtggtggcgcatgcctgtaatcccagctcctctcgaggggagaatcatgaatcgttgaaacccaggagccggaggctgcaggctgcagtgaacagacatggcaccacagtaccccagcctgggtgacagcgagactctgtctcaaaaaggaaaaaaagaaaaaaaaaaaaaagaaacagcaacgtgaattcaaggatattaacagaagcacagtttgtaataacaaaagtttagaaataacatcaatggttcggacgtggtggctcacgcctgtaatcctagcactttgggaggccgaggcaggcggattgcctgagctcgggagttcaaaaccagcctgggcaacatggtgaaacgtctctactaaaatacaaaaaaattagccaggcgtggcggcatgcacctgtagtcccagctactcgggaggctgaggcaggagaatagcttgaacgcgggaggtggaggttgcagtgagccgagatcgcaccactgcactccagcctgggtgacagagtgagactctgtctccaaaaaataaaataaaataaaacaaaataacatcaatgtccatcaacctaagcttggctaaataagtcatgacatattcatacaatagaataatgatcagtagttaagaaaaaaaaaaaaaacgaggaaggaccccataaagagaatgaaaaagcaagtcgcagatttggagaaaacatttgtaaaataaaaagttgtatttggaatacatacatatatacatatacataattttcttttctttttcttttctttttttttttttgcgatggagtcttgctctgttgcccagactggagtgcagtggcgcgatctcagctcactccacctctgcctgccgggttccactgcttctcctgcctcagcctcccgggtagctgggattacaggcatgtgccaccaggcccagctaatttttgtatttttagtagagacgggggttttgccatgttgcccaggctggtctcgaactcccgacctcacgtgatccaacctcctcggcctcccaaagtgctagaattacagtcatgagccacggtgctgggcctacgattttcatttttatttttttcttccagtcagaatcttgttctgttgcccagtctggatagcttgatcttggatcactgcagcctcaaacacctaggttgaagcaaacttcctgcctcagcctcccaagtagctgggaatacaggtgcacaccaccaccgccaactcattttttttaattcttattagagacaaggggctcactatgttgctcaggctggtctctaactcctggcctcaagaaatcctctggcctcagcctaccaaaagtgctgggattataggcgtgagccacactgcccagccatatctggaatatattaagaactcttacagcttagcaataagaaaaacaaatgggcaaaagatctgtacagacattttgccacagaagtttataaaagtatatgagtggcaaatgagcatataaaaagatgtcattaggaaatgcaaataaaacacacatatacatacacatgggatataccattacacatttattagaatgtctaaaattaaaaataaaaataggccgggcgcggtggctcacgactgtaatgccagcactttgggaggccgaggtgggcagattatgaggtcaggagttcaaaaccagcctgatcaacctggtgaaaccctgtctctactaaaaatagaaaaattagctgggtgtgtgcctgttatcccagtttactcaggagcctgagtcaggagaatgacttgaacccagcaggtggaggttgtagtaagctgagatcatgcaactgcactccagcctgggcaacacagcaagactccatcttacaaataaaaaataaagaaataatatataaaaataagaatgggatgggcatggtggcttatgcctggaatcccagcactttggaagcccaagacagacagatcacttgaggtcactaattcaagactagcctggcccacatgataaaactccatctctactaaaaatacaaaaatggccaggcactgtggctcccgcctgtaatttcagcactttgggaggccgaggcgggcagatcacgaggtcaggagatcaagaccatcctgactaacactgtgaaaccttgtctctactagaaatacaaaaaattagctgggcatggtggcatgtgcctatagtcccagctacttttgaggctgaggcaggaaaatcgcttgaacccaggaggcagaggttgcagtgagccaagatcgtgccactacactccagcctgggtgacagaacaagatgagaccccgtccccctgcccccccgccaaaaaaatacaaaaattagctgggcgtggtggtgggcacctgtaatcccagccactcgggaggctgaggcaggagaatcacttgaacccgggaggcagaggttgcagtaagccgagatcgtgccactgcactccagcctgggcaacagagagagactccatctcgaaacaaaacaaaacggacaacaccaaataggagaatgtagagcaactggaactttttggactacaggtgcataccatcacgcctggctgattttttttattttgagatggagtctcgctctgttgccaggctggattgcagtggcgcgatctcggctcactgcaacctccacctcctgggttgaagtgcttctcctgcctcagcctcccgagtagctgggactacaggcatgcgccaccacgcccagctaagttttgtatttttagtagagatggggtttcaccatgttggccaggatggtctcaatctcttgaccttgtgatccgcccacctcggcctcccaaagtgctgggattacaggcctgagccaccgcgcccggccatgtttattttattctttatttttatttttattttatttttcttttatttacttatttttttgagacagagtcttgctctgttgcccaggctggagtgcagtggtgcgatcttggctcactgcaacctctgcctcccaggttcaagtgattctcctgcctcagcctcccgagtagctgggattacaggcgcctgccaccacgcccagctaagttttgtattttttagtagagacggggtttcaccacattggccaggctggtcttgaactccagacctcaggtgatccaactgcctcagcttcccaaagtgttgggattacagatgtcagccactgcacccggccatatttttttataatttgtagagatgggatctcactatattgcccaggctggtctgcaactcgtggcctcaagaggtcctcccaccttggcctcccaaagtgttggggttacaggtgtgaactgctgcacccagccaggaactcttattcattgctgatgggaatgcaaaatggtacagccacctggtatgacagtttggcagtttcttacaaagtttaagatatacttatcatacaacccagcagtcccagtcctaggtgtttacacaacttaattaaaaacttatattcacactaaaatcttacacccatgtttatagtagcttaattcataagagccaaaacctggagacaatcaaaatgtccttcaacaggtgactggataaacaaactggtacatttgtaaaatggaatccaactcagtaataataaagaacaggagcggccaggtgcggtggctcacgcctgtaatcccagcactttggaaggccgacgcgggcggatcacaaggtcaggaaatcgagaccatcctggctaacagggtgaaacaccgtctctactaaaaatacaaaaaaaatttagctgggcgtggtggcgggcgcctgtagtcacagctactcgggaggctgaggcaggagaatggcatgaacctgggaggcggagcttgcagtgagccgagatcgcaccactgcactccagcctgggcgacagagcaagactccgtctcaaaaaaaaaacaaacaaacaaacaggagctgtgtccatgaaacaacatggataagctttaattgcatctctctaggtggaaaaaacttagacccaaaagcccccatattgtttgcttccatttctatggcattctggaaaaggtaaaattatagggacagcaaatacatcaggcccagtgcagtggcactttgggaagcccaggagggaggatcacctgagcccaggagtttgagaccagcctgggcaatatagtgagatgccgtctctaccaaaaaaacccacaaaaagtagccaggtatggtggtgcacgcctgtagtctcagctgctcaggaggctgaggcaggaggatcacttaagcctgggggactgaagctgcagtgagccgtgatcatgccactgcactctgcacttcagcctgggcacagagtaagacccactctcaaaaaaaaaaaaaaaaaaaaaaaaaaaaagaagaagaagaagaaaagaaaagaaaagaaaacagatcagtgagatcagtggttgtcaagggctggggaagggaaaggaagttgatggaactgttctctatgctactaaaatggtagatatatgaccgaatatttcaaaacccttatgcagtaacctttattgtacacaaatatttaagaataaacaaggatgtctgaggatacgaggatggaatgaaaactgtgacaaactaatgtcattgatgaggaagggagaaaaaaaagtcactgacttaattaactttggaaaatgtgttttgactggctaaggcaaaagccaaaagaactgcacattgacactgtactccagttggtaaatttgtctctcacaaaaatggggaatattggcctgggcatggtgactaacgcttgtaatcccagcactttggggggctgaggcgggaggatcacctgagatcaggagttcaagagcaccctggccaatatggcaaaacaccatctctactaaaaatataaaaattagccgggcgttgtggcaggcacctgtaattccagctattcaggaggctgacgcagtagaatcgcttgaatccgggaggcagaggttgcagtgagtcaagatcacaccactgcactccagcctgggtgacagggcaagactctgtctcaaaaaaaaaaaaaaaaaaaatggggaggggggaatattaaaatattgtgaactgaatgaagacaaaattacatgtcagaaatttggagatgcagctaaagaaatacttagagggaaagttgtagcattaaatgtttatattagaaaataagaaatgcctcaaatcagtaacctaattttctaccttaagaaactagaggccaggcgcggtggctcacgcctgtaatcccagcactttgggaggccgaggcaggcagatcacgaggccaggagattgagaccatcctggctaacacggtgaaaccccgtctctactaaaaatacaaaaaattagctgggcatggtggtgggtgcctgtagtcccagctactcaggaggctgaggcaggagaatggcgtgaacccgggaggcggagcttgcagtgagccaacatcgtgccactgcactccagcctgggcgacagagcgagactccatctcaaaaaaaaaaaaaagaaagaaagaaagaaagaaagaaagaatcaactagaataggctgggacaccgggcgtgatggctcacattgtaatcccagcactttaggaggccgagctgggcagatctcttgaggtcgggagttcgagatcagcctggccaacatggtaaaactcgatctctacttaaaaaacataaaaattagccgggcttggtggtgcacacctgtaatcccagctactggggaggctgaggcaggagacttgcttgaacccaggaggtggaggctgcagtgagccaagatcacaccactgcactccagcctgggtgacagagcaagactccatctcaaaaaactaaaaaataaataaataaataaataaaataggctgaaagtagtggctcatacctgtatttctagcactttgggaggctgaggcaggaggatcgctttagctcagctcagtagttcaagaccagcttcaacaacgtagggaaaccatgtctctacaaaaagaaaaaaaagaagaagaaggagaaggaggccaggctccgtggctcaacgcctgtagtcccagcacttttgggaggctgaggtgggtggatcacttgaggccaggagtttgagaccagcctggccaacatggtgaaaccctgtctctactaaaaatacaaaaattagccagcaaggtggtacgcctgcctgtaaccccagctacttgggaggctgaggcatgagaatcgcttgaacccaggaggtggagattgcagtgagctgagatcacaccactgcactccagcctggatgacagagggatgctctgtctcaaaaaaagaaaaaaggaaaaagaaattagaataagatcaaattaaacccaaagtaagtgtaagaaaataaataataaaagacaagagtacatatcaatgaggggtgggcatggtggctcacacctgtaatcccaatactttaggagcccgaggcgggcagatcacctgacgtcagcagtttgagaccaacctggccaacatgatgaaaccccatctctaccaaaaatacaaaacttacccaggtgtagtggtgcatgcctttagtccgagctattagggaggctaaggcaggaagatcgcttgacccggggaggcagaggttgcagcgaaccaagaacaatagagaaaatctgtgaaaccaaaagtgatctctttgaggagggaaaatcaataaaattgataagtttctaaccaggatgatcaataaaaaaagccagaatatttgtgacaggtccagaacatacatatatgctttgtaatggacatagcttctctggattttaaggtgacgattcgagaggaaagcttggggataagagaagaaagagccctttcattgaaataccttttagtattcttttaaatatgcatatataattacatatgcaataattattcacaaataaaatgctatatatttttattttatttatttatttttttgagacggagtctcgctctgctgcccaggatggaatgcagtggcacaatctcggcttactgcaacctccacctccctggttcaagcaaatcccctgcttcagcttcctgagtagctgggattacaggcgtgcgccaccacgcctggctaatttttgcatttttagtagagacggggtttcatcatgttggccagactggtctcgaaatcctgaccttgtgatccgccgccttggcctcccaagtgctgggataacaggcaagggccacctcgcctggccagggggtagtagttttaaaagatatatttatccattcatttaataattgctgtttattatttctacaatacttacacttttttaatacttacagaatactgcaaatgaaggttttctaaaacaatattgttttgtgtatttactttttttttttttagagtctcactctgtcactctgtcacccaagctggagtgcggtggcatgatctctgctcactgaaacctcccaatcccaggcttaagcaatcctcccacctcagcctcccaagtagctggtgccacaggccctcaccaccacaccctattttttgtattttttattgtgtactttaaaattttatgtaaatggcatcatgttatctgaattcttctgtgacttgtgtttttcccttcaacattacattctgaatggttcacctatatttacatgcatagttctattttttcattttcagtgctatacagtattccaacaaatggatatgttatttttatatttacccaggctcgttctgaggatcacttaggttggtgtcctttgttgctatagtaaacaatgctgctgtcaacattcttgtatatctccttatgcaattggtggattttacattatatatatatatatatatatatatatatatgtgtatatatatatatatatatattttttttttttttttttttttttttgagatggagtctgtcacccaggctgaagtgcagtggtgcaatctcagctcactgcaacctctgcctcccaggtttaagccattctcctgcctcagcctcctgagtagctgggattacaggcacccgccaccatgcctggctaattttttgtatttttagtagagacagggttttgccattttggcccggctggtctcaaactcctgacctcaggtgatccacctgcctcagcctcccaaagtgttgggattacaggcgtgagccactgtgcctggcccactcctggtctttttctccacccactgtcataaaaaaaaattcacaagattttgtacagaaatattatgggctcaagggtaattgaggagagaagcagtgatcatgagttcattttaggtcaacaagatagcccctgttggcttagctgacctggttatttctcaaatttaataccaagtaacccaatgggaaaagcaaatcccgtgctatataaatttaaaacgtattttcgtattatactggaggcagaaggctaaagggagtcattctcctcataatgatggagagcgttttggtcatgcaaaatagcttttggtggccttgtgcaagttacttctcattacgcacacaagtgctcttattatatccacatattgcctggtctctagataatttctatgctttatgacagttttttttttttttttttttgagatggagtcttgccctgtggcccaggctggagtgcagcggcacgatctcggctcactgcaacctccgcctcccgggttcaagagattctcctgccccgtcctcctgagtagctgggattacaggcacgcacctccatgcccagctaatttttgcatttttagtagagacggggtttcaccatgttggtcaggctggtctcgaacttctgacctcgtgatccacccacctcggcctcccaaagtgctgggattacagacatgagccactgtgcctggccaaagttagctttctttttttttttttgagacagagttttgctcttgttgcccaggctggagtgcaatggcacacaatcttggctcatcacaagctccgcctcctgggttcaagcgattctcctgcctcagcctcccgagtagctgggaatacaggcatataccaccacacccagctaattttgtatttttagtagagacggggtttctccatgttggtcaggctggtctcaaactcctgacctcaggtgatctgcccaactcggcctcccaaagtgctgggattacaggtgtgagctaccgtgtccggctaattttcttttcttttttttttttttttgagacagagtctagctctgtcacccaggctggggtgcagtggcacgatctcggctcactgtaatctccgcctcctgggttcaagcgattctctgcctcagtctcccaagtagctgggactacaggcgctcgccaccacgcccagctgattttttttttttttttgtattttttgtaagtacggggttttaccatattggctaggctggtctggaactcctgacctcaagtgatccacccgccttggcctcccaaagtgctgggattacaggcgtgagccaccgcacccggccaaaattaattttcttaatcaaagtaatgtgtgtccatagtttagagagtcaaataattttaagaagcttatcatgaaaaacaatgtccactcaactcttcctcttggcatcttccttctggtttttttttttttttttttttttttgaggcggagtcttgctctgtcgcccaggctggagtgcagtggtgtgatcctgggccaccgtgcccggccatcttccgtttttttttttgagacagggtcttgctctgtcacccaggctggagtgcagtggcatggtcatggtttactgtagcctcgacctcctgggctcgagtgaaccgcccaaagtactgagattataggcatgagccaccatgcctggccaacatagcaagaccctccctctattttttaaaaaataataaatttttaaatgaaattttatatatatatatatatatatatatatatatattttattttatttttttttttttgagacagagtctggctctgtcaccaggctggagtgcagtggcatgatctcagctcactgaaatattcacctcccgggttcaagcaattctcctgcctcagcctcccgagtagctgggattacaggcgtgcgccaccacacccagctaatttttgtatttttagtagagacggggtttcaccatgttggccaggatagtcttgattttctgaccttgtgatccacccgccttggcctccccaagtgctgggattacaggcgtcagccacctcgcctggccaaaaaaataatttttaaaaaattagctaggcacggtggtgcatgtacctgtagtcccagctacttaggaggctgaggtgggaggaccacttgagcccaagaatttgaggctgcagcgagctatgattatgcccctgccttccagcctaggcgaccgagtgagaccctgcaaaaaaaaaaaagaagccaaaagttccctgggataggaatagccccttatgagcacctgccaagtcagagtgtccaccatgccacttttctctcgcctccactgcccccttctgtcctggaggagccaggggctgacttgtgagtggagcagggttagtggaaggcttgggtggaagaaatagagaagtcctccgggcaggcctctttttctgtcttcatgtggccagtccaagcaggctgaagtggaagaagggaatttaattaactttaaatgaattttaaattttttttgtttggttggtttgtttttgagacagagtctcgcactgttgcctgggttggagagcagtggtgtgatctcggctcactgcaacctccgcctcccaggttcaagcaattctcctgcctcaccctcccgagtagctggcattacaggcacccaccaccacacctgcgtaattttttgtattttttttttagtagagacaggctttcactgtgttggccaagctggtctcaaacggctgacctcgtgatccacccatctcggcctcccaaagtgctgggattataggcgtgagccaccacgcccggctccaaatgggcttttaaattactgaaccgagactgtttgggggttgtaagtgaccaagataattttattttatttattttgagatggagtctcgctctgtcacccaggctggagtgcggtggcatgatctcggctcactgtaaccgctgcctcccgggttcaagtgattctcccacctcagcctcccgagtagctgcgattacaggtgcacaccaccacacccagctaattttttgtttgtttgtttgtttgtttgttttgagacggagtctcactctgtctccaggctggagtgcagtggcgccatctcagctcactgcaacctcagcttcctgggttcaagcgattctcctgcctgagccttccaagtagctgggactacaggcatataccaccaagcccagctaatttttgtatttttagtagagacggggtttcaccatgttctccaggatggtctcgatctcttgacctcgtgatctgcccacctcagtgacccaaagtgctaggattacaggtgtgagccaccgcacgtggcctatatatatatttttttgtatttttagtagagatggggtttcaccatgttggccaggctggtcttgaattcctgacctcaagtgatctgcctgccttggcctctcaaagtgctgggattacaggcgtgagccaccatgcctggcacaagaaaattgtattgcctgagagtcactaagaaagcaatggctttgggagaccaaggcaggaggattgcttgaggctaggagttcaaaaccaacctgagcaacatagtgagatcctgtctttttttttttttttgagacagagtctcgctctgtcgcccagattggagtacagtggcgtgatctcggctcactgcaagctctgcctcctgggttcacgccattctcctgtctcagcctcccgagtaggtgggactacaggtgcctgtcaccatgctcggctaatttttttgtatttttttaatggagacggggtttcaacatgttagccaggatggtctcgatctcctgacctcctgatccgcctgcctcggcctcccaaagtgctgggattacaggcgtgagccactgcgcccggccgatcctgtcttttttttttattcatttatttagagaaagtgtcttactctgtcacccatgctggagtgcagtggcacaatctcagctcactgcaacctctgcctcccaggctcaagtgattctcctacctcagcctcccgagaagctgggattacaggcacataccgccacgcccagctaatttttgtatttttagaagagacgggtttcatcatgttggccagagtggtgtcgaactccttggctcaggtgatttgcctgcctcggccttccaaagcgctgggattatgggtgtaagccaccgcgccaggcccctgtctctatctaaaaagaaaaaaaaaaaaaagccatgggacttaccctagatttcattcaaggtatggggaagaactggcttcccagagacaaactgaacatgcaaagaataaagttgttttctgtctataccctatgcatgagtcccaccacctgatcaataaattggcttacaacatagtgaaaccacatctgtacagttaaaaaaaaaaaaaaaaaaaaggaaggccagacatggtgcctcccacctgtaatctcacagtttgcgaggccaagttgggtggatcacatgaggtcaggagttcaagaccagcctgaccaacacggtgaaaccctgtcactactaaaagcacaaaatttagccgggcagggtgtcggatgcctgtaatcctagctacttgaaggctgaggcaggagaatcacttgaacccaagaggtggaggttgcagtgagctgagatcataccattgcactgcagcctgggcaacaagagcaaaactctgtcccaaaaaatatacataatgataattggccaggtgtggtggctcatgcctgtaatcccagcactttgtgaggccgaggcaggcggatcacgaggtcaggagatcgagactatcctagccaacatggtgaaaccccgtctctactaaaaatacaaaaaaattagccaggcatggtggcaggcacctgtagccctagctactcaggaagctgaggcaggagaatcccttgaacctgggaggcagaggttgcagtgagccgagatagtgccattgcactccagcctgggtgacagggcaacactctgtctcaaaaaaaaataataataataatcaaaaaaataaataaattcgctacgcttagttttctgtatacttatctctgattggtgtgggttcctctcctgaccagttgggcagctgtggcactgtgtcttgctttaacctttttcctgggctggatctcctgtttcctgaattccatgagttccttttgcatagttttctgcctcatgctccactcacttcctgtcaaaggggtggacactacatatctggaaatgtcttttcgttctcacacttcatggataatttagctgggtatacaatgctaggttagaaatcattgtccttcaggaatggagttctttctcattccagggggcaaatgtgtttcttagctactttacacatgtatgagaaaccaacttttttcttcctcctcttctctctctcctttttttcctccttctcctccttgtttctggtagtggtgggggaaaattctacatcactaggttttcaaactctagagctgtcaaaaagcacacagctgttttcctaacacagactttatttacatagcagaaaaaggacttggcacttacactttgcatattgtttgaattactgttaacagggagagcaggcttatgtaatcaagtctggcttttcttggttgaaaaacttgttcttgtatcttcataaatggtaaaaatgacttttctatcatcccccatactgcaactcttccttttaattttttctttttagaaattatatattgaagtgaattcacataatataaaattagccatttcacagtgaacaattcagtgacatttagtacattcacaatgttatgcaaccgtaatctctatgtagttccaaaacattttaatcactccaaaaggaaacctggcattcattaagcagttagtccccatcccccaattccctaatcccccacatttctggcaactaccaatctgcttcctgtttacctaaataggatttacctattctagataatcagtataaatggaataaaataatatgtaacctttggtgtctggcttcttctacttagtataatgtttttgaggttcatccacaatgtagcatgtatctcacttcattcatttttataactgaataatatgccattatatggatataccacaaattgtttatccattcatgtattaatggacatttgagttgtttctgccttttgtctactgtgaatagtgctgctgtgaacactcgtgtacaaggatttgtttgagtccttgctttcacttcttttgggtgtatacttaggagttgaattgctggttcatatagtaattctttttttttttcttttaatagaggcagggtctctgtatgttacccaggctggagtgtagtggctattcataggcacaatcatagcacaatgcagtcttgagctcctctcctcaagtgatcctcctgcctcagcctcctttttttcttttcttttttggaaatgtagtctagttctgttgcccaggctggagtgcaatggtgcgatctaggctcactgcaccctccacctcttgggttcaagtgattctcctgtctcggcctcctgagtagctgggattagaggcacatgacaccacacctcattaatttttgtatttttagtagagacggggttttaccatgttggccaggctgatcttgaactcctggcctcaagtgatcagcccacctcagcctcccaaagtgctgagattataggtgtgtgccactgctcccactctgcctcagcctcctgagtagctgggactatggcatgtgccagagtacctggctgtcatatgctaattctatgttaacttttttgaagaactaccaaactgttttccacaccagctaaccattttacatccccactggcaaggtacaggggttcaaaatgttcatatcttcatgaacagttggtttttttgttttgttttgagacagggtcttactctgtcatccaggctggagtgcagtggcacggtcatggctcagtgcagcttcaacctccccagactcaagtgatgctctcatctcagcctcctgagtagctgggactacaggtacataccaccatgcctggctaattttgtattttttgtagagacagggttttgccatgttgcccaggctggtctccaactcctgagctcaagtgatgccccttccttggcctcccaaagttatgggattacaggcatgagccaccatgcccaggtgagcaccttttcatgtgctttttggccacttgtatatcttctttggagaaattttgtttatttttctagctttattgaggtataattaacaaattttgcataattcaaggtatacaatgtcatgattgaatatatgtattcattgggaaatggttgccacaatcaaattaacatactcatcaccacacatggttaccatcttttagataaaggcttattcatgtcctttctctgttttttcattgagttgtttggtttgtagttgttgagttgttaaagttgtttatattttctggatattccccttaaaaacggaagctattggaattttttttttttaggcagagttttgctcttgttgcccaggctggagtgcaatggcgtcatctcagctcaccacaacctccacctcccaagttcaagcaattctcctgagtagctgggattacaggcatgtgccaccatgtctggctaattttttgtatttttagtagagatggggtttctccatgttggtcaggctggtctcgaactcctgacctcaggtggtccacccaccttggcctcccaaagtgctgggattaaaggcttgagccatcgtgcccggcctactggaatttttactgttgtaatatcgggtaatatgtgttacccaatgtgggagcaaccatttgttgcttaacaatagccatttctcaaacttttttattttattttatttatttatttatttttgagacagggtctcgctctgtcatccaggctagagtgcagtggcatgatcctggttcactgcagccttcacctcctgggctcaggcaatcctcctgcctcagactcctgagtagctgggattataggcgcacactaccatgtttggctactttttgtaattttgtattttttgcagcaatgggggtctcactatgttgcccaggctcatttctcaatttttttttttagacagagtttctctctgtcacccaggctggagtgccgtggcgcaatcttggctcactgcaacctccgcctcctggattcaaacaattctcctgtctcagcctcctgagcagctgggattacaggtgtgggccaccaacccggctaatttttgtatttttattagagatggggtttcaccatgttggtcaggctagtctcaaactcctgacctcgtgatccacctgcctcgggctcccaaagtgctgagattacaggcgtgagccaccgcgcctggcctatttgcttttaatgtggggcgattataatcaatgctgaaaagaacactcttgcattttaaaacatgcttacttacccaattaattaattcccattggaaaatcttaaagatggttaagatgagtcacaattcagtttcaggaagcaggtaaatgggctggagaaaataaatccagcctcaccaatgccaccctatttagtcctcccaacagccatataaagtagataaaaaatatcactactgtctctttcaaactctgttttcaaaaggtgaggtataagcaatcaagtaaaatggagatggaaaactgaaaaccacgaaaagatcaaggcttgcccatggaacacagataatgtccaagtgataatcattctatgcttgaatcagaagatttggggccatggccaggtgggtggctcatgcctgtaatcccagcactttgggaggccgaggcgggtgggtcacctgggtcaggagttcaagaccagcctcgccaacatggtgaaatactgtttctaataaaagtacaaaaaattagctaggcatggtgatgcacccctgtaatcccagtttcttgggaagctgaggcagggaaattgcttgaacccaggaggcagaggttgcaatgagctgagatcatgccactgcattccagcctgggcgacagagctagactctatcacaaaacaaaacaaaacaaaaagaaagactgggtgtggtggctcacgcctgtaatcccagcactttgggaggccaaggcaggtggatcacctgaggtcaggagttcaagaccagcctagccaacaaggtgaaaacccgtcactactaaacatacaaaaattagccaggcatggtggcatgtgcctgtagtcccaactacttgggaggctgaggcaggagaaccgcttgaacccgggaggcagaagttgtagtgagctgagattgtgccattgcattacagcctgggtgacagagtgagattccgtctcaaaaaaaaaaaaaaaacaataacaagaagaagatttgggtccatgtctaggagataatgtctagatctcaaacagacctagagtcaaatgcctgccacccctcttactgtatagaaggtaagctactcactttctgggcttgggttcctcatctgtccaatgggaatagctcatagagtcatgaggattaaattagatcatgcttgtgaagcatcaggcatgaatttagctctcttgctttttctctgactccacattgctaatcaagttcagcctcatgacctaattacttcccaaagctcccacctcctaatgcatcagttggggttagaatttcaacacatgaatttgtgggggacacaaacatttagtccataacagaaggaacatgggatcagttaggattagattcagttgcatgtgacaacaaaacaaaacaacagtggtttcaacaacatagcagacaatttgacctcacataaatgaaggctgaggaagtctgaggttgctagtccaaggcttacatggctgtgctccctaaagaccttagaagcgcaggctccttccagctctctgatccaccatcctcatcctcctggcccaagatgggaatgagagtgacagccactccatccaagtctgttcccactttggggcttttgcacttgctgggtttttttcttagaaatcttcatctgagcctctttctctgcctttgagtctcagctttggaatgtggtcaccgtctcagagagggctcccctaaccacatgcctcaggcccctcttgttgacccgccttttattcttcatctcacttatatcacctgtatgtatcacctggttctgatacctaccaaccttctgaccttgggcaatttccttaatttcctcaagagcctcaatttcttcacctgtaaaatggggatataacagcacccataggaaacttacactttagattcatgagagtggttggctcttgagtgttggggagaaaagaaacggtgatatctacagtgtccacagcagagcttagaacaaagtagaatctcaataatatttgtgggattaaggaaaatattatgttaataaactcatcttcagttggtgccactactcaatagtagaatattgctcaacattgattactgagtaacattcaccttgagtctccgagaataaaatcagtagaaaactccctgctttgccaggcgcagtggctgacgcctgtaattccagcactttaggaggctgaggtgggtggattgattgaggccaggagtttgagaccagactggccaacatggtgagaccccagtttcttctaaaaatacaaaaattagctgggtgtggtggcacatgcctataatcccaggtacttgggaggctgaggcaggagaatcatttgaacccaggaggcagaggttgcagtgagccaaggttgcaccactgtactccagcctgggtgatatagcaagactatgtctcaaaaaaaaaaaaaaaaaaaaaaaaaaaagaagaagaagaagaaaaaaaaagaagaagagaaaaagaagaagaaaactctttgctttgaattggggggcatagctgggtgcagtggcccacacctatagttccagctatgcaagaggctgaggctggaggatcacttgagcccaggagttccagtccagtgtgggcaacatggcaagacccttatatcttaaaaaaaaatccctcaaggctgggtgcggtggctcacacctgtaatcctagcattttgggaggccaaggcaggcagatcccttgaggtcaggagctcgagaccaacctggctaacatggtgtaaccctatctctactaaaaatacaaaaaaattggccaggcatggtggcgggtgcctgtaatcccagctactcaggaggctgaggcacaagagtcgcttggacccaggaggcagaggttgcagtgagccgagatcatgccactgcactccagcctgggcgacaaagtgagactcatctcaaaaaataagtaattaattaaaaaaaattaaaaactctcaaaataaaaaaaatgaattgaggggagaaaacttcattctcctgagcatagctaatgatctgggactgatgtgaaacccccaaagagaaaaataagaaatttttttttcctttttcccagtctattccttttagacttgggtttgggagggagataaaaagaatgacatgggacgtggcagggaagtaggctgggggtgaaagttgagatcgatttcataggaaggtgaagcagatctctgaagctcccaacatctttgacctccaaggatctcagaagacttgctcattcttgggcaaggctttcaagatcttcatatctgcctacatcttatccattgcaaatcattctggggaattaggatgtgaaggcagccaggatttggccccatcaaataaagaggtaataagattgcaacccacggggcacagatctccaaagagatggtgctgatgtctctgagcccagaggctcccatggggctgggacccaaaccttggagaatgaggcgctgctcagcgttgctggtgctctggctgggtacagaaaagctggttctgtgagtattaaaaagaaaaacaagcaaccccccactccccggcgctgccaaatggaatgaattgctgcttctagggagaagtgctgctggagtgacacaggaatgcgaaatagaacaagacccaagttcccgcttcctcctccagtgctccgttctctctcacatgcgccccctgctggcagatcctaacaaggaacttgatggcaaagtacaaacatggttcctggagtcccaccccaggtacatgagtcaggtatagaagggttagtttgaagctgacagtaccgtaataacgggcacagcttattaatttgaaaactattagatgaaactacacaaagaaccaagaacaaaaacttgtgttccccagtaccattttgcatcctttgtatccggagtttttctttagctgttgtatatccttcctaacagtgtctttattttataaataactaggaagttacccaagaccacacagtaaggagcagaagcaggatttgaatcaaggctgtgtggctccaaagcccatcctgttttttttttccttttaaaatatatatatatatatatttttaggccaggcgcagtggctcatgcctgtaatcccagctactcgggaggctgaggcaggagagtcgcttgaacccaggaggtggaggctgcagtaagccgagatcgcgccactacactctcacctgggcgacagagtgagaccctgtctcaaaaataaaaataaaaataaaataaaataaaataatttttttttgagacggagtttccctcttgttgcccaggctggagtgcaatggtgtgatctcagctcaccgcaacttccgcctcctgggttcaagcgattctcctgcttcagcctcccgagtagctgggattacaggcacacaccaccatgcccggctaattttttgtatttttagtgcagacggagtttcaccatgttggtcaggctggttttaaactcctgacctcaggtgatccacctgcctcggcctcccaaagtgctgggattacaggcgcgagtcaccgcgcccagctagcaatatatatttttttaattcacattttccatcactccctacaaagcccaatctttttttttttttgagatggagtcttgctctgtcgcccaggctggagtgcagtggcacgatctcggctcactgcaagctctgcctcctgggttcacaccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccgaagtgttgggattacaggcgtgagccaccacgcccagccaacacgtttttaattaaaaacaaacaaacaaacaaacaaacaaaaaaaacatgatggggtcttgtcatgttgcccagggttgtctggaactcctgagcacaagcgatgcacccacctggcttcccaaagtgccgtgactaaaggtgtgaaccaccttgcctggtcttgatttttattttcttctgagattttttttcccctacaataaacattaattttaattaaaaagtttcggggctgtgcgcagtggctcacacctgtaatcccagcagtttgggaggccgaggcaggaggattgcttgagcccaggagttcgacaccagcctgggcaacatggtgaaactccgccgggcgtggtggtggcgcctgtacctccagttactcagaaggctgaggcgggaggatcgcttgagcccgggaagtcggggttgcagtgatccatgatctccactgcaccccagcctgggcgacagagccaaaccctgcctcaaaaaaaaaaaaaaaaaaaaaaaagacaaaaaattacttagaattttaccacccagaagcaatcacagctaactgcttattgtattttcttccacagcttttttttgtatctaaatatacacatctagagtttataaatgcaactctttagactctctcacccttccaccctcctcaaatactgccaccgttttgaggccggagacaatggaatttgcttacctaaaaagctccgccccttgatggcgtcacacgaaaccaaccacgccccatattgccgcatgcgcactcttaagaggtcgaacggggagggcggcaggggctctggaacggaagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggtatgagcacggttctggtctttgggtttccttgactgcttcccttcctcgcgattcctcaggtccctgtccccgaatcctcatcatcccctgccagccccggaagtttcccgaaaaggatctcaccgggaccccaagatcttcctcagtttccccgccactaggttatctctacgtccgcctgcttctttggccatgtcgttccctgtctccttgctgaactcagtatctattcactgaactgatatttaaccacgccctgtgtaagagacggcaggtttcttacaccttgtaagaggtgaagtcagccatggttcctgctcaaggagccatggttagctgtcctttcgtatgttcatcgagccagtgtttattgaatacttaacgcctgctagacttagtgttaagcgttgggggcgtagcaatgaacaaggtgagtgccactctcctgaagcgtatggtggtgtgggggcttgcagacattaagcagtatggcaattaaagaggtattggtgttctgaaaaggatgcttgcccttcaaacattcagcccagatgttgtcccctctgcactctcatctgtccgcctgataggtttatccagatgtcccatggcctctacaaattcaactcctccaaagatgaacttgtgttcactctcatcctgttcccttctcaagccagaaaccttagagttattcttgacagttttttcttcctcaccgccgccagtgctctgcaagctagctcatgaatctctcttaagcttctcccgcctctctccattcacactgtacccaccctagctccggctactgctgtctcatgcttgcacaccagcacacctgcagtccaaacatacttcatcttcatctctttatcttgagcacttccagtgtattcttcgcttagcagcagagggatctctgcgatacagtcacgttagagacctcccttgcttaaaactctccagcctgctggtagagacccccgggcctgtccaccttgcaaagactcctcaggcagcgtctgggtcccgtacactgtcgccatttccccgatgtcccctgtgggcgcgggcggccacccaggcctgctggctgcggccccctctcggacaggccttggctcagcccgctgcgtgggaggtcatgggccagtccccgaggagccaggcccctgtacagtgcccggtcacacccatgatgcggggtgtgtttgtcacacccatgatgcggggggaattgtttgtgtttgtttttcaagaaatgattcaaattgctaaaaacaaaacaaaacaaaacaaaaaaaactctccagcctgctttcacgtggctttcaaggtcctcacgatcttgtcctttccaccttgactttcatctctcacagctctcctcttcatgaccaacactccagtctcattcacttcatttttttttaagacagagtcttgctcggtcgcccagggtggagtgcagtggcgcgatctcggctcaccgcagcctccccctcccgggttcaggcaatcctcctgcctcagcctccctagtagctgggactacaggcatgcgccaccacgcccggctaatttttgtatttttagtagagacagggtttcaccatattggccaggctggtcttgaactcctgaccttgtgatccacccacctcggcctcccaaagtgctgggattacaggcgtgagccaccacacccgtcttttttgtatttttagtagagactgcgtttcatcatgttggtcaggctggtcttgaactcctgaccttgtctgcgtgccttcgcctcctaaagtgctgggattacaggtgtgagccactgtgcctggccccttcttgctttctatcattctttatctcagccccaaagtcactctgtctcttactcttcccaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaaggtgagactgacagtgatggacagctccagactttgggctattaagattggactgtgagtttcagggcctagccctgacctgactgaccatctgtttacattcagcagatactacaactcctttgaaaataactggttaaaaaaaaacaaaagaaaatatctggtatacttttgatgagatgggcacagggatcacaaatgactcactgtcttttttttttttttttttctgagtctgcttgctggggagactcctctttaataccaaacaaagtatgagcacttgccaggtggtctccggtggtgtcactgtgcagtgtccctggttcccacacagcacagccaaagctaccacagatgtcattgtcatctgtttgtttgccaagatcccatgcctttctgtgaatctggttaaactagaagatgcatctaagttattttccatttcatgtcttcaaagagaaatattgcctgtccagaacagtttaatccaggctttgctggtccttactctgattgaagtaaaccagcattgccttttctttttttttttgagacagagtctctctccattgcttaggctggagtgtaatggcgccatctcagctcactgcaacctctgcctcctgggtttaagcgattcttgtgctttagcctcccgagttgctgggattacaggtgcccaccaccacgcccagctaattttttgtagtttttttttgttgtttttgagatggagtctcactctatcacccaggccggagtgcaatggtaccatcttgactcactgcaacctctgcctcctgggttcaagcgattctcctgcctcagcctcttgagtagctgggattacaggcatgagccactgtgctcagccttaccagcactgcattttcaagatcgtctggagaggattaaaaaaatttttttttttgagacggagttttgctcttgttgcccaggctggagtgcaatggcgtgatctcggctcactgccacctccgcctcccaggttcaagcaattctcttgcctcagcctcccgagtagctgggattacaggcatgcaccaccacacccggctaattttgtatttttttagtagagacagggtttctccatgttgaggctggtctcgaactcctgacctcaggtgatctacccacctcggcctcccaaagtgctgggattacaggcgtgagccaccgcgcccggcctaaaatttttatatatataatatgtatatgtattttcagagaaggccaaaattttttctttttcaagttaattatgaagagtttgttctcttattcgatgtttcaatgaaaatttctttttcacctctttatttttatctgcagagggcagccactacattagatgagaagattgagaaagttcgaaagaaaaggaaaacagaggtgagaagaaaagtggctatttttcgttgttagggcccactctttactctcaccacgaccccagcatctctctggaagcccttatagagcggggcatggctggggcaggcgcactcttctgtgtgtttgctgtgaatctgtactgagaatccccacagccgttcattcaggccggagagcttcctatcgctctacttaggttctggatttctagaagtttctcatcaccctcactttaatttttttcccaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggtagacgttacggcggaggtgtcagtaatggggacaggagatcagaaggcatcctcctttactttgtagggtttcctccactcttctgcacagtttatctttaagctgttctgcctactacattgaactcctttctttcttttttttttttttttaagagatgttggctgggtgcagtggctcatgcctgtaatcccagtactttgggaggctgaggtgggtgtatcgcttgaagccaggagtttgagaccagcctgggcaacatggtaaaaccccatctctactgaaaatacaaaaataagcttggtgtagtggcatgcacctgtaatcccagccactcaggtggctgaggtacgagaatcacttgaaactgggaggcagaggttgcagtgagctgagattgtcccactgaacttaaccctgggccacagaatgagaccctgtctcaaaaaacaaaacaaaagagatgtggtctcactccatccacaggctggagtgcagtagtgcaatcatacctcactggaaggcttgaactcactggcttaagtgatcctcctgctttagcttcctaagtagctgggcctacaggtgcatgcccctgcgcctggctaattttttttttttgtagggacggggtcttgctttgttgctcaggctagtctcaaatttctaggctcgagcagtcctcccgccttgacctctaaaagtgctggcattacaggcgtgagccactgtgcccgctgaatcctttcttttaggttttcttttctcttgggattttgtttgggttgttgtacttcataggtagtttactcttttcccatctagccccatgcggctgccagatgccactgtgatacaaactcatttggggtgacatactcagatgggtccagccacatagtgggtgctcaataagtatttctttctttctttttttttttttgagatggagtcttactctgtcactcaggctggagtgcaagtggtacaatttcagctcactgcaacctctgcctcccgggtgcaagcaactctcctgtctcagcctcccaagtagctgggactacaggcacacgccaacacacctggctaatttttgtatttttagtagagatggggtttcaccatgttggacaggctggtcccgaactcctgacctcaggtgatccacctgcctcggcctcctaaagtgctgggattttaggcgggagccactgcttccgccctcaataagtatttcttgcagaaatgtgtgctaaagcatcataatacagtgtagtggtcgagagcctggtctctggaccagagtcactgggttagctttctctctgaccttaggcaagttacttcaccatgctgccacaaagtgtcctcatctgtgaaacaaggttgacgatggtcacccctcagaggctgaagtgtggcattggcacttaggacagtgtccagcaggatgcaagtgctttgtaagtctgagccgtggtcatcagctaagtttttctccatagatacactcaaagtaaaggatcggaagaagaagaagaagaaaggacaggtgagcttggggctgcaagacagtatgcagcttgttggcaaaccgaaaggagtttaaggtcgtttgggtttcttggctctttttgttgaattctcttctctcttttggttttctggtgtaggaagcaggaggattttttgaagatgcatctcagtacgatgaaaacctctcgttccaggacatgaacctttcccgccctcttctgaaggtagcagcttcttgtcaaaaattttctttgtagaagcatggtcttgctatgttgtccaagatggtctcaaattcctggcatcaagcaatcctcttgcctcaacctcccagagtgctgggatttgagccactgtgcctggccagtagtggcttattttggcaaccatgggattattgcagccacccctaactggactttctgcttctctctttgcctccctcaactcttgtccatacagttgccagagaactcccttttttttttttttttttttgagacggagtctcactctgtcgcccaggctggagtgcagtggcacaatctcggctcactgcaacctccacctcccgggttcacgccattctcctgcctcagcctccccagcagctgggactacaggcacacgctgccacgccctgctaattttttgtatttttagtagagatggggtttcaccgtgttagccaggatggtctcgatctcctgacctcgtgatccgcccgcctcagcctcccaaagtgctgggactacaggcgtgagccaccgcgcccggccgagaactctcttaagcaatgagttccatcgtgtccctcctcttcttctctgagtccttcagtacttcccagtctcactcttcttagaagcctgagtccttatattgacctacaaggctctgccccttctggccctctctgacgacacctcctggcactcgttctgctctggccacactggcctccttgctggccctcaaataggttaggcctcctcttcctcagggcccttgcactttctgttccctctgcctggaaaactcttccagaaatcttttggggtgctctctagcttccttcagggttcaactcagtatcccttgctcagtgagaccttccctggcagccctaccgtgaatagcactccccctgctgcccgtctggccgctgcattgttttccgcagcatctctccatatgacatgtgtttgttttttggtctgtttctaccagactgtaagattcctgagggcagggtttttatttcttttatttactgctgtgtcctcagtgtctagagcaccacctcacacatagtaggcgttcagtgaatgtttgtggaacgaatgattggtggggattggtgtggtccccacttgtctggaaacctgccctgtttgtgttgtgctgagacttcccccgctcaaccctgtctgacccagttcttttttcctcaggccattacagccatgggcttcaagcagcccaccccgatccagaaggcgtgcatacctgtgggtctattggggaaggacatctgtgcctgtgcagccactgggacaggtgaaaaggatagggacccagggtgggcagaagggtgttacggccagggctgggctctaggttgacttaccaaaggctggtttgctaaataaatattcttggttttttgaactatttcatttttattttttattttgtagagataggggtctcactttgttgtccaggctggtcttgaattcctaggttcaggttcaagcgatcgattttcccatcttggcctcccaaagttctgggattacaggcatgagccactgtgcctggccataaaatttttgtaacacaaaaaagatatactggtgcaattgagagagtaaaggactttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtcttgatctcctgacctcgtgatccgcccgccttggcctcccaaagtgctgggattacaggcgtgagccaccgcgcccggccgagagtaaaggacttttaaatttttaaccactttattttgaagtatttgtagatcagtggcaagttgcaaaaatagtgcatagggtctctcgaatccttcatcaatggtgacatcccacataactgtaggacaaaatcaaaaccaggaaattggcactgatacaacagtgtttcctagactgcagagcttactcagtttactgaaggattaattttttgttttgagatggagtctcactctgtcacccaggctggagtgcggtggcgcaatctcggctcactgcaacctctgcctcctgtgttcaggtgattctcctgcctcagcctccccagtagctgggtttacaggtgcccgccaccacacccggctgatttttgtatttttagtagagagagggtttcaccatgttggccaggctggtctcgaattcctgacctcaagtgatacacctgcctcagcctctcaagagtgctgggatttacaggtgtgagccaccgtgcctggcatactgaaggattaattttgtaagataaacagtgcatgagaggatgtccggtctagtagtgggccacaagtttcaaagggtctgatgaaggtcattttcatttaatcctcttggggtatccctgatctctgtgaccatggcctcctggccctgccatatcagaggaggaaattttttttttttttttttttgagacagagtctcgctctgttgcccaggctggagtgcagtggcgcaatcttggctcactgcaacctccgcctcccgggttcaagcgattctcctgcctcagcctcctgagtagctgggattacagatacacgccaccatgcccggctaatttttgtatttttagtagagacagggttttactatcttggccaggctggtcttgaacccctgacctcatgatccacctgcctcagcctcccaaagtgctgggattacaggcatgagccactgtgcctggctgtattttttctttttttttttgagacagagttttgctgttgtcacccaggctagagtgcagtggtgcgttctcagctcactgcaacctctgccttcaagtgaatctccttcctcagcctcctgagtagctgggattacaggtgcccaccaccaagcctggctaatttttatatatttagtagagacaggatttcaccatattggccaggctggtctcgaactcctgacctcaggtgattcgcctgccttggcctcacaaagtgctgggattacaggctcccgccaccatgcccagctaagttttttgtatttttagtagaattggggcttcactatgttggccaggctggtcttgaactcctgacctcaggtgatccgcctgcctcggcgtcccaaagtgctgggattacatatgtgagcctgaccatgtgatttgaaagcagaaaaaatattctatgaaaaataagttcctttattttccccaaccagacgtagtttttctgtgctctggtgaaaacctaaccctggagggagctaaacttcttctcattgcttccttgctgtccctccctccaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggtgagtttctggccaagggctgccagcccctgagagactgtggtggggtggaggatggatgtgccccgccatctgttggtgttggtgacaggtgccaggagaggcctttgtgttgattgaatccacttaaaaactggaagacttttttttttttttttttttttgagacggaggagtctcgctctgtcgcccaggctggagtgcagtggcgcaatcttggctcactgcaagctccgcctcccgggttcacgccattctcctgcctcagcctccccagtagctgggactaccgccaccacgcctggctaattttttgtatttttagtagagacaggttttcaccgtgttagccaggatagtctcgatctcctgacctcgtgatccgcctgccttggcctcccaaagtgctggaattacaggcatgagccaccgcacccagccgacatgttttcatagtgctttaggtgggtgggatttgattgagacttaaccaaccttcacaaatgaaacctgaaaactatgaacatttttttcgtggtactgaacaaatttggggtataatttctgctctgtgagaataatgaatcaaatattactttgggcagcgtttttccaatgaagttatatgatagtgttatctagcctgcattttgccctccttgtgctattggaagtcagaagtgatctttgtctccctgtaacagacacctcatcactttcctcagctgcttctcttagtccttgaatgtttcaggcattctcttttttttttttttttgagaggaagtctcactctgttgcccaggtgggaatgcaatggcatgatcttggctcactgcaacctccacctcctgggttcaagtgattctcccactgctttccaagtagctggaattataggtgtgcaccaccatgcacagctaatttatgtatttttaatagagatggggtttcgccatgttgggtaggctggtctcgaattcctgacctgaggtgatccacctgccttggcctcccaaagtgctgggattgattacaggcatgagccacctcgcccagcccatgcattctcttctgaagtgcttttgtgtcatcatcattgttgatttttgcacttagcacaattttaatgacatgatctgtctttcccagtgcgtttctgggaaacccatgtgcttgggcctttgtcagtcttactctctcagtggttttctctgcatctggcctgaggcctggtgagtggctggtgctcagtcaacacccatgagcagctgacctggccgcctggtggggctctcttctctttgcaggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggtgctcctcacagcctggggcccagggcactgtggggttccaaggcccagaacctggatgtggacctgccacactgcgttattctttgtggctctgggccatggctgttggtgtgcgataccagatcagccacttgtgctggggcctctgcccagccttagcccatgttttcctcttttttctctttctctattatggtggttaagtgataaggctggtcaaatgttggtcctgccacttcctaagggagatttggaaatatttagattctcaaaacaaatcttttctcatttgtaaatgggagataaggacatacgcacaccatagtgttgaggagctgaggagggaggaagaggaagtgccagcgtggctcccacagggcctctgtgactgcagtggggactccctctccccccaccccgccccccagctctctgttcctctctgtgccatctgctcacctctttgctctgggactgaacagaaggaactcttcctgaactctggactgaggctggaggtggggcaggggaaggagctcgcagacagccccagggcatgctaaggttgcaggcccttaatccctgactcttcaccagcttggggaatggcagctccatccttccagctgttctgaattcttagcgtgtcctcctgttttcacattccacagcccgcctgtcgacacagcctggccacacgcccccactttgtggcttctgcatttgccatttcctcagcctggagccatctcctgccccttcaggtttctgttccagttgttatcttgttagtggggcctttgctggctgccctgtgacggtcctgccctgacttgctcctcccgtcctgcctgcattgtcactgagggttcatggagtgccaagtccccctctctccctaggatacagtattcatgaaggggctactgctatactcccatgaacaagggcatgtctagtatatagcaggcgctcagtaaatacttgttgaataaccaattggctgactcccccagaacagaagacccattcctgaggcctaaaggatgaaaaagagatcattttaagccaaggggatgtgatctggtttaggttttaaagggggagggaaactattcaagtatgtacctcaaaagaccaaaaaaggcggaggaagtatttgagatttagatcaggagacagctctgtgtgatacctggacctagactgtagcctgcactggggagagaaatgctgtaaggggttgggcttgctgaaaacatggaatccaaggaatctcacagattactattatgtataaagagaaagaggatcctttacagtggcgtgatctggcagacactatagccaagtgaccaacctcacatccacagttctggaacaaaccggccgtcagtatctcatgatggagcgtgaatgcagggcacagctgtgcccagcagcgctgtccccatgaggatttctctgaatccagttactgagaaataattatacgaatccagactgtgagaaggatgaggggccttttcgttccttttttttttttttttgagtcagggtcttgctttgtcacccaggctggagtgccatggtgtgaacaccagctcattgcagcctctacttcctagactcaggtgatcctcccatctcagtcccccgacgtagctactactacaggcacatgctaccatgcctggcttattttatattaaataaatagagacggggtctcgctatgttgtcaaggctggtcttgaactcctgggcttaagacacccttctgcctcggcttcccaaagttttgggattataggcatgagccaccttgcccggccccagctcatttttgtattttttgtggagatgaggttttgctatgctgcccaggctgagggggcttttctagatgcaggaagactagagacgtggcagccagttgcaaggcaggaactttggttcttgcactaaaacaaaaggtaactataaaataaaacttggcctggcgtagtggctcatgcctataaccccagcactttgggaggccgaggcaggcggatcacctgaggtagggagttcaagaccagcctgaccaacatggagaaaccccatctctactaaaaatacaaaattagccgggtgcggtggctcacgcctgtaatcccagcactttgggaggccaaggcaggcggatcatgaggtcaggagattgagaccatcctggctaacacagtgaaaccctgtctctactaaaaatacaaaaatattagccgggtgtggtggcgggcgcctgtggtcccagctactccggaggctgaggcaggagaatggcgtgaacctgggaggcggagcttgcagtgagcggagatcgcgccactgcactccatcctgggcgacagagcgagactccgtctcaaaaaaaaaaaaaaaaaaaaaaaaaaattaagtgggtgtggtggtgcatgcctgtaatcccagctattcaggaggctgaggcgggagaatcgcttgaacccgggaggccgagattgtgccattgcactccagcctgggcaacaagagtgaaactccatctcaaaaaaaaaaaaaaaaagacacttggaacctggaggcagctgaaggaatttgaacgtggcctgtgctttagatattcacgcacttgaaagtcttgggtgtgttgatgaagttgtgtttctgtaagagaaggtcctagtgcttaggagttgtgtgctgaaatatttggggtaaggtgttataacatctgtgactgacttgccacaaaaagacaaagcaaatgtggcaaaatgataattcttggtgaaaagataaaataataaaatagatgagtcctaaatgtaaccaatgacaacaaacagcagccggtatgcaatcccgtgtccctcactgtgaccgaagagcactctctccatttctgccatgtctttctctgctcccaggatgctggatgagtactttgaggagcagatgaaggagatcatccgaatgtgttcccaccaccgccagaccatgctcttctcggccaccatgacagacgaggtgggccgagggacttctctgtggcgggtggcaggtgtgcccagagggggccatgcagaggaccctggctgggcttgagggggtttgcctggggtgagcactgcttcctccttccctaccaccttgcagagagctgaggaaacctggctttgtgcttggcaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcaggtggcagcacagggcaagcctgggcagggtgggctggtcagcttccttgagctcgtagtatccatgctgaagtgcttggtttcccctgcgcctctgccgtccagtcttccccagcgcagaggctgcactgcactaatgatgatccgctgcctctcttctccacgggtccttcctccctttgctttatcgcctcaccaatcctctttgtgtcctgttcaactcccaaccacttggcatcagctgctgttgtacccgtcagtccagaccactgttctctgtcgcctggatcgttgcgcagcctcttgctcgagctccctgcttccactcggccttttgtgactctctgcattgcagagcatttacaatgattgcttgcagaagacattcgtacttattatgtccttatttgaacaccctgcggtggcttccattggtcttagactaaaatccaaacatcttagttttttaggactcttcgggcctggcccttgcctgcccgggatcccagccttggaggcttgctcatggctccagccacattcgcctgcttgcacttttttttttttttctttgaggcagagtcttgctctgtcgcccaggctggagtacactggcacgatcttggctcaatgcagcctttgcctcctgggttcaaacgattctcctgcctcagcctcccgagtagctgggattacaggcacttgccaccacttctggctaatttttgtatttttagtagagatggggtttcaccgtgtttgccaggctggtcttgaactcctggcttcaagtgatctgtcctccttggtctcccaaagtgctgggattacgggcatgagccactacatccagccgcctgcttgcacttctcactataagctggttcctgcctccgggccttcatgtttgccatttcctctgtctagaatcttcccctggatcttcccatggatcatctgccttgtcattcaacctaatgtcacctcttcagagaggccagcccttagctgcttccccctcgtccctgcactctctctcacagcatttttcaccccccaggaattggcttctctgtatccaccctggaatttgagttccacaggacagggacagtgcctgtctatccagtgccaggcacagtgaccatactttgtggatgaggagggggtacatgttgaataagagcctagaaacagctgccagctcagtcctctcttcctgccagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggtaacatttggggtggggactgaggctcccaccatccttctggggcagagaggatagaaggaagaagaggaccctgagcattctattagaacattagcaggggacacatagcatgatcttggccttgaacattttaacctaaccactgtgaggtcatgtcttagatgtgtttagaactctaacttcatagtcagagatgaccctcatgtccttggatgcttgtccctagcatgggagctgttgtgtggcgtgacagaggaagctggcttggaaaggcaacacatggtctcttcttggaagctttctgagagtggtgaacattcctgggtctgattgaacaagatttagagtcaaagttagcagccattacttgagcatctactttgccaggcactgtgctgcgtgctttccatgtgatttcttgtttagtcctcagagaatggcatcaaggtggttggcaaggaggaaccctttagaactctccacctaaccctgttcatcagtgggtgctgaaaggtgtttgttaaagataggctgatttaaactgagacaattgcctatgctgttagcagatacagaactacgtttgctctgtatgatgggttgttgaagggtgggtgtaaatatcccatgtgctcacatttagaatctatccctatttttttttttttttgagacggagtctcgctctgtcgcccaggctggagtgcagtggcgcaatcttggcttactgcaagctccgcctcccaggttcacgccattctcctgcctcagcctcccaagtagctgggactacaggcgcccgccaccatgcctggctaattttttgtatttttagtagagacggggtttcaccgtgttagcgaggatggtctcgatctcctgacctcgtgatctgcccacctcggcctcccaaagtgctgggattacaggcgtgagccaccgtgcccagcctctatccccattttaatgccctgttctgtcctctgctggctcaggctcttgtggagcattattaggggagggtgtctggatgaacagctgtttgtgactgtttctaggcgttttaaggatgaacagattgacatcctcgtggccactgatgtggcagcccgtggacttgacattgagggggtcaaaacggtgagcagacactatcttccttggacttttggtggaagtctttttgcctcttcgcaccccccttcccttgccaggcctgacgttcatttttgaccttctaggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaaggtgagcaggcacccctgtggcagtgcagaatggctcggtgggcggggcaaggacagagtgtaatggctgagagcaggtactttgcagttcagagccagatttgaattccagccctgctgcttccttgccgagtgaccatgtgcaggtttcacctcacctctctgagcttgcctcctgtgtgtagaagggaattatgacagaattgtaaacacagtgccccatttaggtggaaattgagaagagaaggttgcttggggcaaaattctcactaaactcctctttcccttactgttggtggtggggaagagagagatcagtactcattctttttgggtcctttcattgattttgttcctctgatctgtgggggtcttataaagcacatcctctttaaagtctttttttgttttgttttgttcttgaattcctaggctcaagcaatccacccaccttctgcctcccaaagtgccgggattaacagtaatgagccaccatgcccagccttaaaaatttttaaagttataaaaataatacatatttagcctgagcatggtagctcttgcctataacccagcactttgggaggccaaggcaggaggattgctagaggccaggagttcaagaccaacctgagcaatatagtgagctgcctgtctctaaaaaaaaaaaattagctgggcatggtggtgtgtgcctgtagtcccagctattcagaaggctgaggcaggagatctcttaaatccaggaggttgaggctgcagtgagctatgattgtgccactgcactgcagcctgggcaaaagtgcaagaccctgtctctaaaaaatgaaatgaaaagtacgtatttattgttggaaattagtaaataaaaaaaaatgtaattctgtgtcaaagagctcaccactggtagcatttaggtgtatgtcttttcaaaccatttttcctttcttaaatgtcccttttatttttttcattttcattgtcttcatttaatcagcgactagttattgagtcctgctgtgggcctagtgctattgattctgttctaggtgctggggatacagcagggaacaaagcagagctgtggttctgggagaaagagacaataaataagctaacagtagatgtgattgagaacagcaggaggagactgcctcattaagctgttaaggaaaggcctctgcacagctggcattggagctgagtcctgggtgatcggaatgaggcagccatgagaggtctgagggcaaagtgctgagctgagagaacaagggtggaggctgtgaggtaggaacgagcttagtgtgtgagaacaagagaaaggtcaggaggctcaggcgtggtgagcagggacacacagaagatcagagcggtaggcaggggccactctgagtctgggggatatgaagcagagaaggcacacattacagacaccatttcctatgtcagtaaatgcacagctaaattattttcatcagttacacagtattagtagtcacccttattttattttatttaatttatttttgagatggagtcttgctctgttgccaggctggagtgcagtggtgcgatctcggcccattgcaacctctgcgtcccgggttcaagtgatcctcctgcctcagcctcccaagtagctgggactacaggtgcatgccaccacgcccagctaatttttatatttttagtacaggtggggtttcaccatgttgtccaggatggtctcgatctcttgacctcgtgatccacccgccttggcctcccaaagtgctgggattacaggcttgagccactgccttattttgtttaagataaggtcttgctttgttgcccaggctggggtacaggggtgcgatcatagcttactgttgcctcgaactcctgggttcaagcagttcttctcctcagcctcctgagtaggtgggactacaggtgtgtgccaccatgatggctaattttttttttttttttagatggagtctcgctcttttgcccaggctggagtgtagtggtgtcatcttggcttactgcagcctccgcctcgtgggttcaagcagttctcctgcctcagccttctgagtagtagctgggattacaggcgtgtgcccccacacccagctgatttttgtatttttaatagagacggggtttcacagcattggccaagctggtctcaaactcctgacctcaggtgatccacctgccttggcctcccaaagcgtgggattacaggcatgagccactgtgcctggctttttttttttttttttttttttttgtagagacagagtctggccacgttgcccaggctggcctcaaattcctgggctcaagcaatcctcccacctcaatctcccagagtgccgggttacaggtgtgagccaccatgcctggcctacccttatttgtaaatcctttttattttctcccattgagatgtcatcctcaaattccgggacaagattgagaaaatggagaaagatgtgtatgcagttctgcagctagaggcggaggaaaaagagatgcagcagtcagaagcccaggtgaggctgcgaggcgggatcttgttcacaaggctgctcagtaagcaagctgctgcatccctgctggtgctgcccttctgaaatgtttctcccatcagagccccaggcatttgcagcccgtggcttcctgtgttagtagatacgggtttcacggcaggcatccttttgttatctctacagatcaatacagcaaagcggctcctggagaaggggaaggaggcagtggtccaagagcccgagaggagctggttccagaccaaagaagagaggaagaaggagaaaagtaagtcagggaggttccgcagaaatctaaatacagaattaccccacaggactcagcagttccatttcctagttctatactgtaaagcagcggtccccaacctttcggcaccaaggaccagtatcgtggaagacaatgtttccacatttggggtgtgggggttgcattagattctcataaggagtgcacaccctagatccctcgcatgcgcacttcacaatagggttagtgctcttatgagaatctaatgctgctgctgatctgacaggaggccaagcacaggtggcaatgcttggttgcccaatgctcacgtcctgctgtgcagcctggttcctaatacgccatggactggaaccggtatgcagcctggggttggggaccactgttgtaaaggatgtaaacagggactcaaacagatacttagatgccagtgctctttgaattactgttcataatagcaaaaaggtggaaacaaactatgttcatcaacaagtgaatggataaacaaaatttggggtgtgtgtttatatacacacaatggaatattattcagccatgaagttctgatacatgccataaggatgaaccttgaaaatcttaagctgaatgaaataatccagacacaaagggacaaatactgtctgatttcacttacctgagatatctagctaggcaaattcacagagacagaaatagattatagattacttagggctaggggaaggggggttataggaaattattagtggttgcagagcttctgttttcaatgatgtcagtgagtagcctcctgataggagttttggaaacagatagtggtgatggttgtacaatgttgtgaatgtaagtaatgccactgaattgtatacttaagattgggtaaaatggcagcctttgttttatatgtgtatatataaccacaataaaaataattttaaaaaagttaggagatatttaatacagatttcctctccatctccctttaaaaaagacccaaaacacttataagttcacattgttctatgcctcgccttttcacttaattttgaagcttagagatatgttttatataggcccacatatgctgccctttttgttttttgttttcagacggagtcttgctctgtcactgaggctggagtgcagtggcgcaatctcggctcactgcaagctctgcctcctgggttcaccccattctcctgcctcagcctcctgagtagctgggactacaggtgcctgccaccgcacctgggtaattttttgtatttttagtagagatgggatttcaccgtgttagccaggatggtctcgatctcctgacctcgtgatccgcctgccttggcctcccaaagtgctgggattacaggtgtgagccactgcactcggccccctttttgttttttttaatggcttcatgttcttccatcatatgagtagattgttgagggacattgaggttgtttacaatcatttgtcatccagcctgggcagcatggcaaaaccccatctctactaaaaatcaaaaaattagccagacatggtggtgcatgcctatagtccaactacttgagaggctgaggtaggaggatcacctgagcctggggaggtcaaggttgcagtgagctaagattctgccactgaactgcagcctgggcggcagaatgagaccccgactcaaaccaccaccaccaacaacaaaaaacccaaaaaataatcatttgtcattacaaacaagtgatgtagggaataaccttgcacatatgcccttttacaattaagcaagtgtatatttggcttgcaggattaattcctaaaagtggaatagtgggtcagaggatatttgtatttctagttttgttagaggttgcaaaatttccctcctagagggtataccagcagttttagaaatgctgtctatatttgatgggacaaaataagggtgtatataacttaaatttctgataaaaatagagttataactgtattggtgggtaaagtagtaaagtgacctaaatcttcatccttcatagcaggaggtttgtaatgagtatcttaagtggattgagaaatagtcaaaaaagcatgttatttagtgagatggaggtaatcagtggaagaagtgcttgcggcttttcttttcttttttttttttgaggcagggtctcgctctgtcgcccaggctggagtgcagtggcgcgatctcagctcactgcagcctccccttcctaagttcaagcaattctctcacctcagcctcccaagtagctgggattacaggtgcaccaccatgcccagctaatttttgtatttttagtagtcggggtttcaccatgttggccatgctgatcccaaactcctgacctcaggtgatccacccacctcagcctcccaaagtgctgagactacaggcacgagctactgcactcggccaagaagtgcttgccgcttttcattttaatctgctaacttaccaattgaaaacgtgcacttcttatcgtaagcttaaaaaaagataaaatcatccctgaaatcttatgctttcttctcatcccagttgccaaagctctgcaggaatttgacttggccttaagaggaaagaagaaaaggaagaagtttatgaaggatgccaaaaaaaagggggagatgacagtgagtggcctcccttttggagtttgggcccactcggtggggtgggtcagagtggcctggtgtgttccacactcacacctccccactccccctaggcagaggaaaggtctcagtttgaaatcctcaaggcgcagatgtttgctgaacggctagcgaagaggaatcgcagagccaagcgggcccgagcaatgcccgaggaggagccagtgagaggtcctggtaggtgaatggggagcccaaaggagcttgtacaaggttttccctgaaacctgtgctttgggtcagggagaaaatctgagggatgatgacagtagcccacattatttgagtaattagtatgtaccaatgtgtacagctatccctccacggtctaaggggcgcagtgaccttgtggttgttgagaactaggatttgaacgccagcttttctgactccggagcctaaggcctcaccagctgctacttggaggagctggtgaggacagaatgaaaatagtctttggatgccagagtatccactgaacttggaatcattaccttgaacttaaggggatttaggagcttgggccaaagacaaccatatgtaacccattctctctgtgcacagccaagaagcaaaagcaggggaagaaatctgtatttgatgaagaactcaccaacacaagcaagaaggccctgaaacagtatcgagctgggtaggattttaagtcatcatggagcccttggtattctttttttttttttttttttttttgagacggagtctcgctctgtcgcccagggtggagtgcagtggtgcatcttagctcactgcaagctccacctcctgggttcaagcaattctcctgcctcagtctcccaagaagctgggactataggcgcacgccaccatgcccaactaatttttgtatttttagtagagatggggtttcaccatgtttgccaggatggtctcgatctcttgacctcctgatccacccgcctcagcctcccaaagtgctgggattacaggcttgagccaccgtgcccggcgagcccttggtattctaatggaagctatgagtcttctgcctccttccccatttccagtttttgcacacctatagctttatactatgtaaattcaagggtacctgtctgttctccaccccccacccctctcagagccacctgaggatcccaaggtgagaacaggagaggggtgttcagttagcactgttcctgccttggaggtgaaatagtacattgttgggttcagaaatggagctttccttcaggggagtgataactctttcatctcaagttccatcctgcagaaccccagagaatcctggcttgctcttaggaatatgttgtcccacaccattttccccagcccaaggttggggcaggggcagactaagcttcccaagtagtggtatatacctaagaagggcctcttccaaccttgttttaaaattgggccctgacttccagaaacacgttatcaggtggaaacacataaaggcttagaacttagggcctgaaaatgatgcatcccagagatgctactgcttcatgtaggagctggggagggtgggggtgagacaacacccatttgttcaacagtttgctcatttcagcatgtcatcttctctcacagcccttcctttgaagaaaggaaacagttgggcttgccccaccagagacgaggaggaaactttaaatctaaatccaggtgatactggctgttttggaggggcataggttttgggattagagataaaaacctttcatggaaaagaagcttctccatcctcattctggtcttaactctgattttcttacagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaccaatccaagtgtatatcttattactatctcttcctcaatggcaaatgtgcccacagtctactagcttggtatcaccacatacagttggtatgcataatctttatgcttgtagaggaacagggtatggagtgaggaaattcttggtagaagttctcttctagcctggggaacataacaagaccctgtctcttaaaaaaaaacaacaacaacagaaaagttctcttctgttgatactctagaactaagagctaaatgatagctgaagaagatagctaaatgataactcttagttctaaaacatcaacaggggagaactttagcatgaatgccaaccatgcaccagatattctgtgtgctgaatagaatccagtcaactcactgcactcctgtgaggcaggcagtgatatcctcattttccaataaacagaggcttggaaagactaactttccagagttgcacagctgggaattcaggttttcaaccaacatctacttgaaccctcaccttacctcttgctgctgtgctgtggaaatgctgctggagaaatggaagcccgaaaaggacagaaggagccttgacaccataaattagttacttgctgcaaaaaccagagtctcttgtcctccaggctggagtgcaatgacacgatcttggctcattgcaacctccacctcccgggttcaagcgaatctcctgcctcagcctcccaaataccggtgattacaggtgcccgctaccatgcctggctaatttttgtatttttaggagagacagggtttcaccatgttggccaggctggtcttgaactcctgacctcaggtgatccaccacctcagcctcccaaagtgctgggattacaggcttgaaccactgtacctggccaaaaaccagttttgatcctgtaagaacgtcggttctcatccttttctgactcagaatgagatgaaagctgtggggccccacctggaaaactgtatagtttgttataatttcagggagtacttaccaccctacccccagcttaaaaattataagttatccagtagcacataccctagatactaaagagtgtgttcaaagctattcattcaggctgcacctaagtcaccaacagagggtccaattcagaaaatgatggcacaactgtgtgatggagtacagttcagactactgtcttactggattttacagaaagtaggttattaggctaaaaaagccaagtgcagaactgtgtactttttcttttccttttcctttttttgaagcagggtctcactcttgcccaggctggagtgcagtggcttcactgctcactgcaacctcgacctccccaggctcaggtgatcctcctacctcagcctttggagtagctaggactacaagtgcaagcaacaacacctggcttatttttgtatttttttttttgtggagatggtttcgccctgttgcccaggctggtcttgaactcctgggctcaggccatctgcccaatgtggcctcccaaagtgctgggattacagatgtgagccaccatgcctggcctaagggatgtgtattgcatgtgcataagttctctctgggaggactcaggaagttaacagggtttgcctctggagaaagaaacttcaggtatacccttttgtacaggctgaaaaaatgttctttttaccgtgggtaaaaatgattcattcaccagctaaataaaaatcctgtatcacaaaaacaaaatcacagcctcactgtagacagtgccttccctgtgcccgtcttcactgtctttggctgagttgcttctgaaaattgaggatacacgtggaccactgattttctcaatcattgtttttaattggctttataagctaaagtgcatagtaaagacaaaaaaaggaaatgcatacataggaaagggacacttagaaaggacctgagatacctaaatgtctgttctaaggaacactggaaggagggaatgcagatgcaggcagcaggcctgggtctggcttctggcctgggtttggagcctgcagaagctgctggcatgctagctctacccagggaacagctccaagagggagtgttgggatgaaggatcacacttgggataggtgctgctggtaccaaatgtgattttagctccattcagggcccaggggtaaccagcagtgccaccaaacctgtcagcaggtaaagaaacttctaccatcccaaagtgcaggttacaggaaaggggtcactccttaatgacgacctgggcctgctgcataaggcccatcttatgcagcatgtgggctgtcccatcttccccactctcagtgactatgtaactgtgtcagggtgagttggtgcagtcttttgtcttatcacgtgcctccatctcctggaggcagggtgcccaaggagggcagggaggggttcttgtgctcctttaagggataagcagttcataaacaactatgggcctctgtttattatgagagttagtctgcaaattagggcctggcaattagaatcggtctgcatcaatgagctcatactctgttcctggggaacaatgtagaataaacatctgaccaagtaaagacccagagataccactaggtggccctaggtggaagccccaaacatgttccagggagtctgtccactaatttgcaggagagaaggggtgagatttgttaactttgctctcagttctggagataaagtgcttactctagcgcaggggtaaatctagaaacaaatgtgggtgagccctaaaagtggatccttaagtaggtgctaagactaaaaagaatgatttttttttttttgagacagagtcttgctcctgtcgcccagactggagtgcaatggcatgatctcagctcactgcaacctccgcctcctgggtttaagcgattcttctgcctcagcctcccaagtagctgggattacaggcgcccgccataacgcccagctaatttttgtatttttagtagagacggggtttcgccatgttggtcaggctggtctcgaactcctgacctcgtgatccgcctgcctcggcctcccaaagtgctgggattacaggcgtaagccactgcgcccagcctaaaaaggatgataataaaaaacaaacttcagttccttcattagggagctggccccagtcattcagtggcgagggcaaaaggcagtggtgtaccatcttcctacatcatcccctggatctcctcaaagttcatcaggttgttggccgtgtcagaccaggcagcatgctgggctccatccatttcagaagcaagctggttgcttctttccagagtatgatttgtgccaccaatcacttccttacagtcaggacacgtgcccctctccatggctcccccacaatcgccaatcacatagatatggccattgcggcacttgaaccagtgaccacgaggataacctatggcactgacaatctgcactcgctcttcctctgagatgcccaggccagagcagggaagggtggctttcagagcttccatcttttcctgcacaagttgttcatcctcttgggtgaacttacatgttttctcaaggatattctggacactatagacctctactgctatgctatctttcaccttcttctctgctatcttgtagcgggtcagaaggttcaccaggtatgtgagcctctggatttcacttcggaggtcacttagttcctggctagtgaagctcaagcgcttcttggccagccactcatggacctgttctagtcgagtcctcactcttttctcttctaagacatgcatctttttcagggaatcccacaggctggccaggtggtcatagaagctgatgtaattctcaaccagacccaggtccttcactgacagatttttctgggccagcttctcctttaacatcaggaagtcttcaggaagcagctggtggaggaggctcttcctctccagcagggccttaagccgttcctggctggttgctatttcccctgctgagccctggatcttttccttgatgatttcaatctcttctagccgctgttttatgctagttccatacctcaggtttttgcggatgggcacctggcagatagggcagactttcaatctgatggcgacttcatcatccttctgttcattcatgtagcggtctagggcttgcacctcaaagatgtggctgcagtcttccagctgcacaaagcgggcatcaggctcatcctcaaagccaaagaatatttgggtgacctcatccatgtggcagatccggcatttcttggggcatggctccccacagagaccaatgcaggggtggccacaaactagcagcttagtacaaggcacatagcatgggggtcggttgcagggctcagagcagagtttggtgcactggtagtgctggcagcgccagacacagggttccacgcagggactacacagctccccacatttcttcttgcactggctgtggacacagcggttctgacaggtccgctggcagggtgggcactcaccaatgcatggttcctggcacttgtgtgagcagataagcaggcgcttgcagggctgctgacagcgttcatggaaacgcccttcgaagcagctgtggcaggagcctgggcaaggatgcccgcagtccaagatagtgccacactttgtggtacacttgactagcagaccaccatacaggaggccttccacatgaccacattttaccggttgactgtgcccacacttgagttttatggtgaccatttctgaacacagctgcacacagtcctcaccacatgggtggctgcatctgtgcccacatctcagagacttggagcaaggctcctggcagcagaaatctgactcaggcacggaacaagggaccatttgttcatggccgcaccgaggaatggttttgggcaccttcacctgacaaggctgacactcctggaagcaaacaaggggacaccggtgcccttcctgacagatgaccttctggcatggcttcatgcattggaactccttgtgtgaagagtcataagggtggcaggcacgggtgcagacatgcccacagcccaggcggaactcgcagggcaggctgcagcctccttcgggtactttttggaagtcagaagctttggatactaaggtgtgggtttcagggtggttctggcagcagagccggagcatggggcctatttgattgttctctcgaagtgtatgaatgatcttgctccacaggggcaccttggccagcatctgcatgtttccgatgcagtacattcccttcttggctcgggacaaggccacacagatgcggttggatatctgcagaaaacccaccttgccttcttggttgctccgcactagcgagaggaggatgatgtcattctcttccccttggtatttgtccacaacatggaccctgacgccagcaaatgtcttggcaggcatcagtttgcgcaggcagaagagctgcccggtataggtagtgaggatggtgatctgggaaggcaggtattcctggcacaggaagtacttgcacagctctaccacaaagtgagcctcatgctggttctgatggcttttgccctcttggatttcctgttcaggaaagttgtgttctacaaagaaaaggttggaagacaccccctgacagggaaaagaagtgacatgttaaaaggttcactcatggcacttgtttttttcttcctctcttgacatgcactggccacttactctgctccagagagagaccttggaaagctttttgtccactcaacatcactatctttagttctttagttagtcattgtgtgcttcattttggggccacagcaagttatgaaaataaaagattatgtctctttcagttttcaagatacttgtttgatgttaatatttaaaaaagctggctgggtacagtggctcacgtctgtaatcccagcactttgagaggccgaggtgggtggatcacctgaggtcaggagtttgagaccagcctggcccacatggtgaaaccccgtctctactaaaaatacaaaaattagctgggcgtggtagtgggcgcctataatcccagctattcaggaggctgagatgggagaatagtttgaacccaggatgcagagattgcagtgagccgagatcatgccactgcactccagcctgggtgacagacagagtgagactccatctcaaaaaaaatagaaaataaaacagccatccacaatccaaccattatagctgaaagaacaagcagtgctgtgaggaggatgatgataatgacagagcagctaacttactgagcactccactgtgctgactgctttatatacattacctccttccatacagtaatgggatatggcaggagccattattcttattgtccagaagaacctgatactcagaatttatttatttattttaaaaaaagagacagtcttgctatgtgccccagcctggttttgaactcttggcctcagctgacaattttttttttttgagacagagttcactcttgttgcgtaggctgaagtacagtggcacggtcttgttggctcaccacaacctccacttcccaggttcaagcgatcctctcgcctcagcctcccaagtagctgggattacaggcgcccaccaccatgcccagttaatttttgtatttttagtagagacggggtttcaccatgttggccaggctagtctccaactcctgacctcaggtgatccacccatcttggcctccgaaagtgctgagattataggcatgagccaccacacccagccaggcacatgccaccgcacccagctaatttttgtatttttagtagagatgggatttcaccatgttggccaggatggtcttgatcccttgaccttgtgattcgcccgcctcggcctcacaaagctctgggattacaggcgtaagccaccgcgcctggccagaattcttatataacttgcttaaggttacatggctaacaggcagaattgggattaaaaaaccctggtctgtatttcaattttctcccagtaaccagcttttaaaaagctggctctactcccttctgaaggctttctttttttttttgacagggagtctctctccgctgcccagcctggagtgcagtagcatggcacgatctcagctcactgcaacctccacctcctgggttcaagcaattctcccacctcagccttctgagtagctgggattacaggtgcttgccaccatgctcagctagtttttgtattttagtagagacagggtttcaccatgttagttaggctggtctcgaactctgacctcaagtgatctgcccacctcagcttcccaaagtgctgggattacaggtgtgagccaccgcgcctggccgctgaaaagcttttttatcttgaggaaattatagcctttttaggttgctgacaccatccaagaaagatcgggtaagacagactcaccttaatcttctcatacttaagaacagatggatgattctccagatcctggtaaatgtggggggtcaaaaggcgggcaatttcagggcacatacggtgctgaaaaaacacatgcatgtcattagaaacatgggcagagcacacacggacaatttctttaaagataaggttgctgttagaaaatttagggagggccagttgtgatggcttgtatctgtaatcccatcactttgggaagccaaggcaggaggatcacttcaggtcaggatttcaagaccagcctggcaacatagtgagccctcatctctatttttctttcttttttttttttttttgagacgtgtcaccaaggctggggtgcagtggcgcaatctcagctcattgcaacctctgcctcccaggttctagtgattctcctgcctcagccttccaaaagtagctgggactacaggcatgaggcaccacgcctggctaattttttgtatttttagcagagacagtgtttcgccatgttggcgaggctggtcacgagctcctgaactcaagggatccgcccgccttggcctcccaaagtgctaggattaaggtgtgagccaccacacctggcctctatttttcttttcttttttttttttctgagacagaatctagctctattgccaggctggagtacagtggcatgatctcggctcactgcaaccaccgcctcccaggttcaagcaattctcctgcctcagcctcctgagtagctgggattacaggtgcccaccaccatgcccggctaatttttgcatttttagtagagacaggctttcaccatgttggccaggctggtctcgaactcctgacctcaggtgatctgcccaccttggcctcccaaagtgctgggattgcaggtgtgagccaccgcacctggcctctatttttcttaaaaaaaaaaaggaaagaaaatctagagagatagagattatcatttgaaaaaaataaggagaaagcataacataaacagctcctttgtccaacaaaaactcaacacggtgatcttgtggtgttttaaaacagaaaatgtaaggttgacagagtcatttcagtattaaattatttttatttatatgagacctcttttgctggcaactggcagcttcccaggagctttctcctgggcatttggtaacaacagaggcccagcttctcacctggtaattcagacggacaaagggaatgtttactttcactagccgttcaaaaagggacacctcaaggttgaagttcttggccagatcatacacgttggcactggggcgcagctgagaagagaaacatggctgaggattctctactgataaagtcatttaaccatccatacttccatccatccaaccaaccatcaaatgtttttcaagtgttgactatgtgccaggcactattctacatactcacagtttaaggattaataatgacaagggttaaggattagtagaactaaaggtgatatgacagagtgccccatggtgggttttttctagctaggcctctgaacagtgacatctgagtagacactagcatggcagaagttgccagttcttcagtcatttgaaaagcaagatccataatggggagcggaaaggacacagtgggacaccaagagcaaatgggatgaagtcagagaaataagctgaaacctgatcacataagcctttgtgggccactttaagaagcttgatttttatgcaagtgcaatgggacaccactggagggttttcagctggaaagtgatattatctatctaccttttttttaaaaaaattcactttggctcctttatgtagagtgcattaaaaggtagcaaaaatggaagcagagagactgaggagcatgctattacaatacagtccactcaagaggccatggtggactaggtaaatagcagagggaatggatgaaataaatgacgttgccactaaaatataccccaaatctaatagcatctgctcttagactgaacgtgggaggtgaagacaagaggaatcacaagaagctactaataagcttgaggactgttgaagcagaggccagggtcttcctttatgatctcacccccacggagagccagcccatcttctagggggactctcgttttacctgctggtggtccccaatcaaaatgaggtgctggcaagctttgctcaatgtggcaatggtatgggcctcaaggacttccgcagcttcttccactatgacaatcctcggctccaccttctgtaggatctggcggtatttggcagcacctcaagtgaggaaagaagagaaaggctcctctgagctgaggcacaggacccacagggccactgggcctctgggaatccacttctgtatcttccctgaacctgcatcagcgacagctggtccttatagtgttctgggtggtctccagaacattaaaactgtgttggtcactgttggagtttcaaacccagcaggagaaagtgagtgaatttcttttttctttttttttttttctttgagacagtctcactctgtcacccaggctggagtgcagtggtgcgatctcagctgactgcaacctccacctcccaggttcaagtgattcttgtgccccagcctcccgagtagccaggattacaggcacccaccactacacccagctaatttttgtatttttagtagagatgagatttcaccatgttggccaggctgattgcaaacttatgacctcaggtgatccacctgccttggcctcccaaagtgttgggattataggcgtgagccactgcgcctggcgaaagtgagtgaatttcaccaagagttctcaaaatatgggtgctttcagtagcttttcatggtattttcctctaacctaccaaagaagctcctctttacctgtccttagataatctggcaccagaagtgaacttagatgcaacaggcaaatttctccacagtttcttacctgtggttgtcattcctacaacctgggcatctttaagaatgtgcaggtcttcctggagtctcagctcggccattctttctgctgatgtgcggtactggcgttcatagctgaggatcttccggcgggtgtcagcctggtacaactgtagccagagcctggagaatgggaagaaccaaggaaagaaagccacatgctctttgagaaggtggaagaacgcccttcagtgtgcccagtgtatgaagtgaaccttggacccttggagcatagtgacaaacagagagatacattcagggacctaagaatccaaaatgcccaacaaaaagatgtgcagagtagtcaggagctaaggaaaggggtgagataaagaacaaaggttaactatgggaagaaaataagagactttaaaaactttgggaagaattctcccagctgcagcatccctgcctaatttccctcccctcctctaattctccatagagtatttattttattagtaaaactgatgatgtcactaatcgctgtaaaactttccaacggctttctactacttttttttttttttttttaaaagacggagtcttgctctgtcacccaggctggagtgcaatggcgtgatcttggctcactacaacctccacctccgggttcaagcgattctcctgcctcagcctcccgagtagctgggattataggcaccggccaccacgcccagctaattttttgtgtttttagtagagacggggtttcactgtgttagccaggatggtctcaatctcctgaccttgtgatccgcctgtctcggcctcccgaagtgctagcattaaaggcgtgagctactgcgcccggcctctcctactcttttttttttttcctgtagagatgaggtctcactatgttgcccaggctggtcttgaaccctgggcctcaagagatcctctagcctcagcctcccaaagtggtgagattacaggtgtgagtcattgtgcctgttacctctctgttcttttctgagtttttatacccatttgtaactttttatttgtggaattacgtgattaatttgttaccctggatagactccataggctccacgaaggtaataattaatttgttaccctggatagactctataagctccatgaaagtagagcaaagtgtctattctatcccatggctgtatccctatcactcagctcagtggtggtgctcaatcaataattagttaacatcgttgaaggtcttggaggtggagaatgttctaggaacagaagaggaactccctacatgggttggctagatgtggaacacagtacctataaagctgccagcgagaactgaggtccagctgccaaacatcctcgatctcgttggcctcggctgcagtcatggtgttcagtttgcgaagctcatccttcactctttttttcattttctttttctggttgcgctgggtctgcagacatcaataccaggcagggtactgtctgagcagaggcaggcttggttttaagcccaaggcaggggtcacagcacgtaagaaaaagggctggcatcactgattaatgtcaagtgtcttacattctcccaacagctcttccactgtagagtggctaaacaaggactctggagccagtttgcctggcttcaaagccctactctacctcttactaggttgtgggacctagtaaggtaaatgacctaacctctgtgtccctcagtatcaccttctataaaatgggaataataatggtatctctttataggattgttggcttgtcaggagtaaatacgtggaaagcatttatactagtactagcactagttatcattaaacatctttgaccatagcctgtttcttgttcctaaaatgcatgccatgaaagtcatgggggtggtactttcttgttgaatgctgtacaaccagtgcctagcaactggtgcttcacacaggacttggcacagtgcctgctaaaacggtcctactgccatcgtatcaacacagtacctttaacaagtggtggaaagcactgtttatgagaaagtgctctcttctggccgtcactgagtctgaggctatgagcctttagaaggctcgcaagtcagacagatgtcactaaataaagatcttcccgctgcttcaaaatgaaacaaatcaacctttcctgatgcctcctgggagagatgctgaatctgtgcttctaagaattgagatcatgactccgctcaccacatatagtgatactgaactgaactagatcaggtgcaaagccagcactcagatgaaaactgcatccaaagttgcccttgaaagttctcaaatcattggtaaggtttacaaattcttattttgaatatctaatcctcgatcatcatagttatgcatggtaaacagtgaggactactaggctccaccaaaaggagcagagggaaggctacatgaagacacctgggcattcatacaattctggctttaagagaagtgtcaaattccaggctgaatgaaggaggaatattccatccagcctggaggtctcgcttcattgcttactttaatcctctaaaatcttagtacatgttcacaaactcatttgaaatagagaaaacaacactcctgaaggcattaagtactgagaccgtgtttgacctgactcatatgtgctacattcttccacaagttctacagaagcacttggctacctgcttcctgtctttctaagttggcatttcttgccagaggccctctgaagaaccatcgtatttatatccttgggaatcactaaagccatctcataccaggggtaggctgtaatacaggtacttagctaattgtaatggtgaagtgaatatactgtatcagaagtgggggaaaacaagcggtcagaacactctcaggcctgtttcaacccaaggaagtgagtttacctgccactctcctgtggcttgctcctgtccagctgctgtcccagtgccacaatggtctagcctcatggccagaagcattttagccaactcctggtctgctccactctcttccttcttccgccgctggggcctcaccacctcttcctcctcaatcacccggtctgcttgaatcaggtcagcttcctctgcgatctctatcagcgaactctcctcctccccttcttcctcctcatccccttctgcctgggctaagagagagaaacaggcaggagagagatgaaaactctttttttttttttttttgatatggaatctcgctcttttgcccagggtggagtgcggtggtgcgatcttggctcattgcaacctctgcctcctgggttcaagtgattctccggcctcagcctcctgagtagctgggattacatgcacccaccaccacgcctggctaattttgtaggctaattttgtatttttagtagagatggggtttcaccatgttggtcaggctggtctcgaactcctgacctcgtgatctgcccgccttggcttcccaaagtgctgggattacaggcgtgagccaccgtgcctggccagagatggaaactcttgaagctaagggacagaagacggcacctgcaagagctcagatgcatgaagacattatcaagggtttatgtgattttttttttttttttgagacggagtttcactcgttgcccaggctggagtgcaatggcacaatcttggctcaccacaacctccacctcccgggttcaagcgattctcctgcctcagcctcccgagtagttggcattacaggcatgcaccaccacgcccagctaattttgtatttttagtagagacagggtttctccatgttggtcaggctggtctcgaactcccgacctcaggcctgcctcggcctcccaaagtgctgggattacaggtgtgagccactgcacccagccctatgtgattatttttgagaagagaaactaaaaggaatgagaggagagttaggaaaggcttaaggtctccttatatactttttgttacgttttacgttaaaaaatcatacgaatatatgccttttaaagaaaggttttggctgtgcgtggggcttatgcctgtatcccagcactctgggaggctgaggtgggtggatcacctgacgtcaggagttcgagaccagcctggccaacacggtgaaactctgtctttactaaaaatacaaaaattagccaagtgtggtggcgcatgcctgtatttctagctacctgggaggctgaggcaggagaatcacttgaacccaggaggtggaagttgcagtgagccgagatcgtgccattgcactccagcctgggcaacagagtgagactccatctcaaaaataaataaataaggctgggcgtggtggctcatgcctgtaatcccagcactctgggaggccgaggtgggcagatcacctgaggtcaggagctcaagaccagcctggccaacatggggaaaccccatctttactaaaaatacaaaataagctgggtgtggtgagtgtgcctgtaatcccagctacttgggaagctgaggcaggagaattgctcgaacctaggaggcagaggttgcagtgagccgagatcacaccattgcactgcagcctggtggacagagtgagactgtgagactcagtctcaaaaaaaaataaataaataaataaataaataaaataaatacacaataaataaataaaggttttacttataccaaatacatatacaatggagggcatacaatgtaaatatgtaatataaaggataataaaaatatataaaatgaatacccaagtaccttccacccaatttaagtagaaaactgacaaattttttgaagacctttgttagccttcctaacccgaattttatattactcatttcctttttaaaagataataatgttaccacatttatactgtatctaagtaacacattgtctagtatatatgtttccataacttgccttttttttttttgagactatgtctgtcactcaggctgtagtgcagcattgcagtcatggctcactgcagcctcaacctcctgagctcaagccatcctctcgcctcagccacctaagtagctgggactacaggcacgcaccaccacacccagctaaactttttcctttttttttttagtaaagacagggtctcattatgttgcccaggctggtctccaacttctgggctgaaacgatcctcctgccttgcacttgcaaagtgctgggattacatgcatgggccactatgcccggctaacttgcctttttcattcagcatgtttttgagattcatatgtgttactgtatatgctgtgtttcattccttttcactgttgtacagtatttcattatctgagttgacttaattgatccatccattgaagaaatgttgatgaacatttgagttctttctgattttctgctatgataaagtggttatgtaaatttaaatatccccagcagcagtgcatcagagtttccattgcttcaaattctcatcaacatggggttatatcaaactttaattgttgccaaactggtgtgtaagtaatagttatctcattgtggttttaattcctctagtttttaatgagcacttttcatatatctattgaacaatttcctattttgtgatgtgcctgttaaaagtcttttatctcattagctgcgcgtggtggcacttgcctgtaatgccagctacttgggaggctaaggcaggagaggagaatcgcttgaacctggaaggtggaggttgcagtgagccgagatcacaccactgcactccagcctgggcaacaagagtgaaactccatctcaaaaaaaaaaaaaaaaagtattttatctcttttccttatattaagctatttgtctttctctgattgactcatagctctttatttattctgggaattatttttaagtctcactgttctggtatttactatattctacgttaagatttgattctaggaagacatgcacttcttacctgtattctcaggtcctgctggagaaacactttgcgtgaaagaaccgacaccaagacctagccactccagcatcatggaatgcttccagtgctggaagcaaatccattcactatcctaaggaaagaagaatgatcatttgtgaggattctatgacaaccaatgtgaaggctgggtctcctcaaagaatcaaaagcagattggggcatggtagctcatgcctgtaatcccagcaatttggaaggccaaggcaggaagactgcctgagcccagaaattcaagaccagcctgggcaatacggtgagaccctatgtctttaaaaagagagaaaaaaaaaagactgggcgtggtggcttgcgcctgtaatcccaacactttgggaggctgaggcaggcggatcacctgaggtcacgagtttgagaccagcctggccaacatggtgaaaccctgtctttattaaaactacaaaaattagccaggcatagtggtgcatgcctgtagtcccagctactcaggaggttgaggcagaagaactgcttgaacccgggaggcagaggttgcagtgagtggagattgtgccactacactccggcctgggtgacaaaagcaagattctgtctcaaaaaagctgggtgtgatggcatgcacatataatcccagttacccaggaggctgaggtgggaggactgcttgagcccaggaggccgaggctgcagtgagctatgattatgccactgccctccagcctgggctcaagaccctatctcaaaagaaaaaagaatcaaaagtaattcccttaaagtttataggctgtactattcacaacagcaaagacatctaatcaacctaaatgcgcatcaatgaaggactggataaagaaaacgtggtacatatataccatggaatactatgcagccataaaaaagaatgagatcatgtcctttgcgaggacctgaatggagtttgagggcattatctttagcaaactaacacaagaacagaaaaccaaatactgcatgttctcacttataagttaaatgatgagaacacatggtcacatagaggggatcaacacactggggcctattgaagggtggaggatgggaggagggagaggagcaggaaaaataactgatgagtactaggcttaatatctaggtgatgtacaacaaaccgccatgacacaagtttttttttttttttttgagacagtcttgctctgtcgcccaggctggagtgcagtggcacgatctcggctcactgcaagctctgcctcccaggttcacaccattctcctgcctcagcctcctgagtagctgggactacaggcgcccgccaccatgcccggctaatttttttatttttttagtagagacggggtttcagcgtgttagccaggatggtctcaatctcctgacctcgtgatccgcctgcctcggcctcccaaagtgctgggattacaggcgtgagccactgcgcgcttggcctcatgacacaagtttacctacgtaacaaacctgcacacgtacccctgaacttaaaagttaaaaaaaaaattaaaaaagaaacatcatattgttaaaaaaaaaaaaagttcagaggctgtgaactggcatctccttgggcaactggaacatttaacatgacttgtatagaattttaaaaatcaaagggctgggcacggtggctcatgcctataatcccagcactttggagagccgaggtgggcgggtcacctgaggtcaggagttcaagaccagcctggcgaatgtggtgaaaccctgtctctacaaaaattagccaggcatgatggcaggtgcctgtaatcctagctactcaagaggccaaggtaagagaatcgcttgaacccgggaggcggaggttgtagtaagccaagatcgcgccattgcactgcagcctggggtgagagagtgagaactctgtctcaaaaaaaaaaaaaagaagaaaaaaaaaaaagaattaaaaaaattttccagcctattttgacaaaatcaggagctatggcagcaatgactgtttattactgaatggcaacaaatggctggagctgggttgctaccacatctgttctagtttgccacagtcctctccgcttcttaatatttcaaatctagattgcttcacttatttgtaagacctgaatgacctctgtaagcttttggtttgtaatcctgtaaatcagcaacctaatggtaacaaagctaccatttcactgggttcctagcctgccactttacagagactgtctcagttatttcttaccatatcttttgaaggtaggcattattattatccatgtttgattgctgaggatcacatgaacccaagtcacacagtcagtctgcatgactatatctatcaactcccaagttctctatctgtgctagtttgcctctggttatgattttcttcatttcatttaacaaacacttatagtacagttactaaattaataagtttacaaatatcaccttgctcatctaaataacaatcctgtaagaacaaagatctgtaagaaattgccttttttgcaaatcaatattacagatgttggcaatttcatatggttcaacttaatgcttattattatccccattttataaaaggggaaacagccacagaaaattaagtaacttgtccagagccaagctcagactaaaacccaacaggctggttcgagttttgttcctgaccagcatattcagctgcctctcatcacaaaagggaactttacacattgtggcagcatcagattatcaaacaggtaaagttttggactgatgcttctcctggaggctacctcaaagtactgaggccagagacatatttgtgtcccccaggatgacccctacctgcactggtccattcatgagactttcccagtgctggggtgagatgtacttctgcaggtactgttcccgtaggacaccacgcatggtgcactccagggtcttggctccttcatgaagctcttgctctgactccttcatctgtgtcatgatcttccaagaacagagggaaagaaatgatgaggaaatatcatcatcccccaaactcagtcctcaccttgagggaaagcaaagctaagacaggaacagtaaggagggagaataaataaatagactggtcaacaaaccaatttcccaaggcacattattgtggtcttgaaaccaaagaactagtatcggttgagtgtggtggctcatgcctgtaataccagcattttaggaggccaaggcaggtggatcacttgaggtctgtagttcaagaccagcctggccaacatggcaaaacactgtctctactaaaaatgcaaaaattagccaggcgtggtggcaggttgaatatcccttatccaaaatgcttgggactagaagtgtttcagattttggaatatttgcgtttatacttactggttgagcattgcaaatctggaaatccaaaatgtgaaataatgttgggccgggcgcggtggctcacgcctgtaatcccagcactttgggaggccgaggcgggtggaccatgaggtcaagagatcgagaccagcctggccaacatggtgaaatcttgtctctactaaaaatacaaaaattagccaggtgtgatggcgggcgcctgtaatcccagctactcaggaggctgaggcaagagaatcgcttgaacctaggaggtggaggttgcagtgagccgagattgtgccactgcactccagcctgggtgactgagcaagaccctgtctcaaaaaaagaaataatgttggcactcagaaagttttggatttggattttccaatttgagatgctcaacctacacaacagaaaaacaaacaggccaagaatactgtgggagagacttcaaggctcacaatatctgttctctctcttttccttagtaataagaactcagatttttgactgggcacattgctgcccagctaaaagatgacatttccctggtcagttggctgtacacagaggtgctgtgggtggtatgggggaaggagcgttaaggtagggtggggatgggcagtgtttccttgtcttttctccatcttggattgtgaaggcaaaggtcataccaagggattggcagaatagaatgctgaaaggaacctgggtcctccagagctttgaggagcctccaaatctaccctgggctgcctacccagaaagccactgctatcttgtttaggtccctcttgaactaccccagatatttcagagctgggacttacactcatgtaggcccttcggaggtgcatggggaggttgcggcggaattcccgcttgttcctcagctcccttagggtgaactgcttcaggatttcactgttgctccttccacccacccgcacaatgctggtcttctgacaattgtagatgcctgtggaacaaagtggagcatggcagggttgagaggagcttatgctaggttctctcaggtgagagctgtgtgtatttgggatctagtctggtcccttagagaataaacttgtgcttaaaggaaatttaccccattaatgagtgagaaggtccccgagaagatgtgacctgcagagcagtaaagtgtagcacttaaagagtacaggttctggaatcagacaactagggatccaactcttagctctaccacttattgctgtgtaacctggggcaagtgacttgagtctcagtttctctgtctgtgatttagagatggcaatatctcccatatagggctacagtctggataaatgaaagaaaatctttaaagctcctagctagggcccagcacaaagcaagcacccaggatatgttacatatttttcactctgcagatttactgattgctcatatgttttaggcatgtgccaagttctgaagatatagcagtagaaacataggcccagtttctgatttgttatcatttctttgtctctggcaggaagttactcattaaataattaatacggcagcaataaatgtagtgagtactggtagcaggggacattacctagtctgggtggggtagggatctatttttaagaatctaatatttaaactcagactctaagaataaagatttatctaggtgaaagggaggtatagaagaataaaaataaaggaaaagcatatatttattcatccattaatgttatttagtattttttgagtgcctaatatgtgccaggatatgtgaatacagcaagaaaaggaccaatcctcatctagggtagcgatacataaaatagattataaaaaaataaaaaatgcaaaagagacttcactttggggctatagaaaaagtccacctgagaagagagatttaaagtgggaccagaagaatgagtagggccaggttgagtagggccaggttgaataagctcaagatggagagggaaaaaactattccaggccagaggatggcatgggccaatggaggacgtagaggctttcaaggaactgaagataaccagtgttgctggagttagggagaacaaggttaagaagtaggagctgtggttcacagtccagctgggacagatcacaaacggccatgtaagtaatgataaggactgttgactttgtttgaagagcaatagaaagctactgaagttgctgatggttcaatcatcaacatcttgatagagaacaaatttgcctataagtattaccttccagaaactggtccaaagcatgattagtataacacacaaccaagatggggaacttctggaggctaatttgccaaacagactcgttggttaggagggcctgaacaatttttagacccacataggttttgcctagaaaataaggaaaaaggaatttaacaatttagacattttctaaataaagtaattactcagagcaaaatctttttttaaatttaatataatacattaagatagtttaaaatctaagaagcgtacattgtatattgtgaaaagtccctcttgcactctgtcacccagttctctgggtggaagcaaccaatgttaccagtttcttttgtaactttacagagacagtatatccacgcatatacaaacaatacaaatgtgtattctttttctagacttccccttttctccttaaaatatgaatagtaacagacaatttttaccattctacatcttgatttttttcacttaatgtatcttgaaggtcattctctatcaatacataggagaatcccatcccccccacccccccctttcctttttacagctgttaaggtattttttagccagttttctattgatgctgtatatattgtttccaatcttgtggcaaattagaaatactttttatatacatggtagatttgcttttgtgatgggaggggaaaacttgtagaaatcaacattggaataagagttataggctcattagtaaatggccattaattaattaattaggctaaaaactgctaaattctctctttttgtttgagatggagtttcgctcttgttgcccaggctggaatgcaatggtgtgatcttggctcaccgcaacctctgcctcccgggttcaagtgattctcctgcctcagcctcccaagtagctgggaccacaggcgcatgccaccatgcccagctaatttttgtatttttagtatagatggggtttcaccatgttgggcaggatggtcttgatctcttgacccttgtgatctgtccgccttggcctcccaaagtgctgggattacaggcgtgagccaccatgcctggcctgctaaattcttacattgtgtcaggctggtaaggtagacactgtcctcaaaaatctcaaagttgagggagggagtgatataagataatcaaagatttcactacagcaggataagtaacaatttcttccttcttttttaaggccctatgttgtccagactggagtgcaggggctatgtgtactgcagcctgaacacctgttttcaagggatcctcccatctcagcctcccaagtacttggtactacaggtactcgtcaagacgtccagctttgttacataaagttttttttttttttttttaaatcatgagttgccattacttcattggtgttttttaaagacttcttcctgtttggggttttgttttcttttggtacttcctttcggagagtaatttagcagtagctattttaactgttaatgtaaattcccacttctaataatagttatgaccccagagtagaattagagagtggcacctggggagaaaggtatgggaaggtatagttccacgacaagtacaatgtggcagataggagccaggattctacagctagactgcctgaattcaattcctaaacttgtcacttaacatttgtgtgagcttcagtacatacttcccacctcttaagaggttatttaacccttctttgccttagctttcttcatccgtataacagttttgtttttttttttgaggtggagtcttgctctgttgcccaggctagagtgcagtggagcgatctcagctcactgcaagctccgcctcctgggttcacgccattctcctgcctcagcctcccgagtagctgggactacaggcgcctgccaccatgcccggctaatttttttatattttttagtagagacagggtttcgtcgtgttagccaggatggtcttgatctcctgaccttgtgatccacccgcctcagcctcccaaagtgctgggattacaggtgtgagccaccgtgcctgaccaactgtataatggttttagtaatggcttctatttcacaaggttgtgaggatgcaattagttaaggtatgtaaagtaagtaaaatgttgcttcacacatagtgctattatatatttgatactatttaatttaaaataatataaaattgaaccaattatataaagcagaaatcacacatctcactacatttgacctctagcaatcttgtatctattactatgcatgacaatgggttcctattggaaaatccctatgagcagctactttataaacaaattttatgcccatttcgggaggaatgttattaactaaacattctattgcaacaaaaccaaaaattgacaagtggtacctaattaaactaaagagcttctgtacagcaaaagaaactatcaacagaataaacagacaacctacaaaatgagacaaaatatttgcaaactctggatccatctaaggtctaatatctgcaattaaacaaccccattaaaaaatgagcaaaggacatgaacagacacttctcaaaagaagacatacacatggccaacaagcagaggaaaaaaatgctcaacatcaacatcactaatcattagagaaatgcaaatcaaaaccacaatgagattccatctcacactagtcagaatggctattaataaacagtcaaaaaaaagtcaaaaaataacagatgctagtgaggttgcagagcaaagggaaagtttatacactgctggtgggaatgtacattagttcagccactgtggaaagtagtttggagatttctcaaacagcttaaaacagaaatgccatttgacctagcagtcccattattgggtatataatgggaaggaatataaatcattctcccataaagacacatgcatatgcatgttcattgtagcactattcacaatagcaaagatatggactcaacctagatgcccaacaatggtggactgaataaagaaaatgtggcatatatacaccacggaatactatgcagctatgaaaaagaagaaaatcatgtcctttgcagcaaagtggatggagttggaggccattctccaaagcaaattaatgcaggaacagaaaattaaataccacatgttctcactcataagtgggagctaaacattgaatacacatggacacaaagaagggaacagacaccagggcctacttcaggatagagtgggaggagggtgaggatctaaaaactacctatcaagggctgagtgcagcggctcacacctgtaatcccagcactttgggaggccaaggcaggtggatcacctgaggtcgggagttcgagatcagcctgtctaacatggtgaaaccctgtctctactaaaaatacaaaattagctgggcgtggtggtgcatgcctataatcccagctacttgggaggctgaggcaggagaattgcttgaacccaggaggcagaggtcgcagtgagccggaatcgtgccactgcactccagcctgggtgacagagtaagactctgtctccaaaaacaatgacgacaacaaaaaactacctatcaggtactatgctcattacctggatgacaaaataatctgtacaccaaacctctgcaacatggcaatttacacatgtaacaaacctgcacatgtacccctaaacctaaaataaaagttggaaaataaaataagtaaataagaagacattctagaaacctagagtgaaggctccgtcccttgcttatcttacaaagcagatcttatgtactctaaaaaattttgtcttacctgttccaggaggtccttgaataatagccagttcccttgtgagagcaaactgcaaggcttccatctgggagtcatccagcttcagggcttcttttgagggccactggccaggatctaagacattaattctgggatgtctcaaaccctcgacatttcttagaaattccccagtggctgaaggattctctattaagggggtaaagtcgtatctgccccccattagcaagtaccttggctccttcacatgagagttacactccacgatattcctctggaagggaacatcttcctcctggacctcctggagtccttccaggacgtgcctgtaggcctcaaagtatgcagttgtctctaccatgaggaaagagtcagagggctggacctctgctagcagctgttggctttgctcattgaagcagagctggacaattcctcggcagagatcttcctgctccctgttagatacggtggcaaaaagaaatgtctcgaagttgtccttggacatgcataccaaagacccatagagcaatcgtttggaattctgccagcgaacaaacttcagtggttttgtgtcaaactgcaccttgtagactatgcctgatgatgaacacatgggggtgataatcctggtgtcaaagtagattcggatgtcatcaaactttctcttcctcaggccctggtcttcaaagctttggagaagttccaaaataccttcccgtaaaggtctgacgaaatcttctcgcaggagccggaagtgggtatccagatagatagcagtgctgtcgtattttccagaaatgatattggggcgaaggaagggcctctcatccaagtgcacttcattgtaggtagggtaaatgggcatggttcggtagctctcaacatggtcttctgcctcaggctgcactagagtgtaggtatccactctcaaagtgccctctcgcctcttttcctgcagatgttcaatgatagtctgtaccttttccaggttcttctccgtttcctcttctatgtcaacaccagaggctctcagagcattaagagaggttggcaggagggaaaccagcatggaagtttcctgcacagagctggcagggaagacacttacaaggtcctggaggagggagatgatgttgcttatgtgctctggatactggtttcggatgtcagggatgggttcagtgatcatccctaccacataagcaggcaggcagactttgagaaatttggagtttttcaatatgcccagtacatggagaacactctggcgatccattttggagctacaagccttccgaagaacctgacagatgagctcaaggaagttagatttcatggaagaatgagaaaggagctctttcagccctaaacttgtggcaagtgtgatgaccacctcagaagggtctttctgcagaagactttctaagaacttgtagcccagtttcttcgcctgctgtggctgttctgtaggcttctggtggggagtccgccactgctggaagttgtcattggaccatggtggtctgcggttcctacagtcctggttgccatttctccacctggtgtcattctcctggtcatgtctttggtctctagcttcgtcgctggcatgcccctcctggttcctccttccttgatgtgggttcctgcccatggccctaaatctctcttccctctgccagtaagcagcaggatggttgttggccctaggatgccttccagggtggctggctcctcctcggagagcattggctggtgggttattggcctgatttctagctcttggtggtaactctccatccacagggcctaaacacaatgaaatattgagtaaccacaagaaccaagttctgttggaaacccaacagaacgacaatgaacgtgctttcattttccaaaataactaaagagctcaggttttatacggtaagaaaaacggtttctaccaagtcatatgataaatgaaagataattactgttgctgtagaggttaggaaaatattatttttacaaaggacgcaaaagggaaaaggaataaacagttattgagtacctgatgtgtgttagagaataaatacatacagtatgtctcattgcttctaatctcatgccagtaccaaataacagtcagaacatgagtttaaaggccaaactgacttggttcaaacattggcctggccactgccttactatataaccttggccaagttgtataatttctctaagtctcagtttctgctttttttttttttttgagatggaatcttgctctgtctcccaggctggagtgcagtggtgcgatctcagctcactgcaacctctgcctcctaggttcaagtgattctcctgcctcggctcccgagcagctgggattacacacacctgccaccgcgcctggctaatttttatatttttagtagagatggggtttcaccatcttggccaggctggtcttgaactcctgacattgtgatccacccgcctcagcctcccaaagtgctggaagtgctgggattacaggcgtaagccaccgtgcctggtggggattttataaagattaaatgtttataaagtgcttagtatagtactggacacattaaaaactctcaataaatgttagttattactagtagcaataattgggaatatcctattgattctaagggggccactggttctaccactaaacaattatcacagccaacagagacatcaagtgaaataatattacaaagggaagtactacctgaatgctgtccagcatcagcaaatgcagtttgaatgggaaagagaaaggtggggtttccttaccaagatgtttttgagctaacagactatgaaagaaactgaaaaatgaaactcaagttttcctcctttctgtagcatgaacttcaccctcatagtacttaccaattaccaacccttatacaggaagcctaacatacccaaagtccagtttttttcactttcctttttgctaaaactgattctggggctgacctaacttagcagaatgacatgaagattttaaaaacaaataaaatacgactgtatacaatgatttgataaaaaagttgtaaaagcttcaaatgcatgttatatttgagatgattataccatttcctgacatcagatactaaattgatttatgcacactcttccttgttttgcattttgtagagaattttattttttattttttattttttgagagggagtctggctctgtcgcccaggctggagtccagtggcatgatcttggctcactgcaacctccgcctcccgggttcaagcaattctcctgactcagcctcctgagtagctgggactacaggtacctgctgacacacctggctacttttttgtgtttttagtagagatggggtttcaccatgttagcctcgatggtctcaatctcctgacctcgtgatccgcctgcctcggcctcccaaagtgctgggattacaggtgtcagccaccgtgcccagccgagactttaatgtgacaacataaaggaatatttggtaaaatataaatgatctacaactgaactctaaatttttataattgttacttacatatttacttttcaaactacctccaaaatcagaagaaagtactacttttaatatttttatctgattagaagactctatgtcttggaagaatggaaaatcgtatcatttcttattctttcaacattcatggccaggtgtggtggctcatgcctgtaatcccagcactttgggaggctaaggcaggcagatcgcttgagctcaggagtttcagaccagcctgggcaacatggagaaaccctgtctctactaaaaatacaaaaatgagccacacgtgatggtgcacgcttgtggtcccagctacttgggaggctgaggtgggatgattgcttgagcccgggaggtcggggctgcagtaagccaagatcatgccatggcactccagcctgggcaacagagcaagaccctgtctcaaaacaaaaaacaaaccattcacatagctcacaagagcccatagttcttcctcatttgttccacagctaaaactctttggaagacacatttcaaacttatggaaaagcaggaatccatttggttgtttagttttagaaagtgctgagcaagcagaataattcctttagtagagtgatggtcttggaactaatttagctttggtgactaggattcacgatctgcactatccaatacaaagccattagccacatgtggctgctatgtttgtgaaatgtaactactttgaattaagacgtgtaaaacacacgagattttgaaagctagtaccaaagactgttaagcattacattaaaaatttttatgttgataatatcttaaaatgagtatttgagggaaataaatatatgtgaattattaaagtatgataataaactatagtcaattattataatcaaataacattttggttatactgggttaaataagacattattaaattcctaaattttattaaattgtcatcaaattgaaaaaataaatttcaaggccaggcacagtggctcacgcctgtaatgctagcactttgggaggccaaggtgggtggatcacctgaggttaggagtttgagaccattctggtccaacatagtgaaaccctgtctctactaaaaacacgaaaattagctgggcatggtggcaggcacctgtaatcccagctacttgggaggctgaggcaggagaatcgcttgaacctgggaggtggaggttgcagtgaaccgagatcgcaccactgcactccagcctgggcaacagagcgagactccgtctcaaaataaataaataaatacataaataaatttcatctgtttcttcttacgttttaaaatgatgtttctagaaaataaaaactaggccgggcgtggtggctcacgcctgtaatcccagcactttgggaggccgaggcaggcggatcacgaggtcaggagatcaagaccatcctggctaacacggtgaaaccccgtctctactgaaaatacaaaaaaattagccgggcgtggtggtgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaataaaataaaaaataaaaacttatgctcttggcttacattgtttctattggatgctgctctacaccaaacgtcatttccctttctgaaactctatcactgtttttgttaaagtgaactgcacccattcatcagctctcttaggaaaagtggagggttggctgtttttcagagtaattcatgaagtaattaagaaataactcattctttttttttttgagacaaggtctttctgtcacccaggctggagtgcagaggccagatcacagtccagagcaacctctgccttctacacccaccccttcctgaggttcaagggatcctcccacttcagcctcccaagtagcctaagtagctgggactacaggcacgcagcaccaagcccggctaatttatatatttttttgtagagaaagcctattgccatgttgcccaggctggtctcaatcccctgggcgtaaacaatcctcccgcctcaggctcccaaaatgctaggattataggcttgagccactgcatccagccatagtcattctttacttgagagatgcagacaatcttaggtaggcctgctcatttatagagagccctatttccttcttttattactagaatttccttctcattaggtaggaaaccttgcttacctctgtggttggtatgggaattcctgggcctggcatccagatgaggtcttctctcctccatgtctgagtcacctgaattccttcacgttactttctgttatctggaaaactgcacatgttgagttatcagtgtcctcgaaacatagcatctagcagcaaaaacccaaacaccatcaagccagtccttctgcctttgttaacattttaatgatttgttaactaagggttaaatacagattttaatctagagcacaagtgctcgactctgcaaatgcccaattatgatataaaatattaaattcacaatttagctgatttcaagagatagaattcccctttcttttaccctggcactttcttggggtagagggaatgtcatcaattcccattcaaaactgctgtttggtttatgcctttagccaagttacttaatcagttgctaggtttcattttcctttcctaagaagcagacaatattgttgccaggacaaaaaggagtacatttttgttaatccaaaaccatgtgctcaccaccttatctggcatttacatatctgccacttatatagtacccaatagcttgcagtaccctacagtttataaataattagtgagcagttatccccttagcctactctttggaatggagccaaatgattaagctctctgctctactgaatcaagagaaagaaattacatgtttcaataaccaggaggtttggcaactacgaggtgctgtttcctcaggaccagctagaaatctgatattctttcttcctcctcattcttctaccttggtgatttttgacactggtcctgtaagaggaagaggaagcccctttaagggagcttctcaacccaactcatacacatggtgtgggctggggctaaggaaagagtgggtgactcagagtcctcagcaaagggatttttgagactgtcttcactgagttctaaaatattcataattggaaactgtgactacatttggcattatatgaggggcagcttttttcctcatctgaaaaaggagtctcttttcttccccctgggaatatctctggtgagtcccctccctcatcttatcaaacccagccctcctggcgcaggctcagtatttagagtttgtttgtttattttcaattctccgaggggaaaattccttcttccccttgttgaaaaatgctaaaatagaaactccagaaaatttaaaagaaacggaagaaaagaaaaaaagatgttaaaaaaaaggcaagggaaggaagggaggagtagacatgaacaggaaatgctgggatcgaaaacagactgaagtgtttttttttggtggggggaatcaaggcctaaagggcacgaagaagaaaatcagtgatgatcaagctggcctggagtcagaatgagaggggctagtcatcaccagagtgggacgcaggaggctgaggtcggaggcagagctgggtttgggggaagtctccagggtcctggggaatccctgacccagggagcccacggtccctaatggaaatgttatggggtcagggagcgccaaggctgtgaggtggcggggttatgggggccttggggagagggtggtagcgagcaccagggggtgcttgctgaggacggaggcggcggggtgggggcagggagcaggctgaagggggtgccgaggtgctctgtagaagagggggattgataaggtgacaggaggtgaggccggaggaatgaggggggtgcgagtggcagaagggagggcacagacaggggtaggggcagaggagatcgaagtgctgagggcagaagcggtgacggtgtcgggggtgctggggagagcgacgggccagctgaggggatggggacactaaagagagtacaggggagccgaaggggcgacggggcgctgagatgggccaggggctgagtgggtgacggggcgctgagtaggcgatggaggtctggggtctgagggggagacggggcgctgagaggcgctctgagtgggtgctgatgccgctgggggccaaagaggtgacaaggctctgagtgggtgatgggggtctggggattgagggggcgacggggcgctgaggggccaggggctctgagcgggtgacgggtgcgttgggggcttgagagggtgacaggtcttacgggcagaggcagtggcgggtcggcgcgggcgccggggttcgcggcgaggcaaggaagaatcaggggcaggggcagttgcggggccactcacccggctccggcgcgtcctttcactgccgccggcgagtgctggggcttcggcccaggcaggtcggtggccccgcccggcgccgcgcactttcggtttccgttccccgcagaccctgggcggagccgggcgggcggcccagaggaggagaaggaggaggcgggggcccagggtggagagcacgagggcctggcccaggcacggccggcgcctccgccctcgaggagggcgtcacctcagctccccccggcggcggagccggcgggctcaggcgggcgcggctgaggggagcggaccgcggggggcgggagatgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggctattttaaacaggaggcatgtgggttacagctgtgggaagggcaggaaacttgtttacagagctggttgctaggagtgagggggacttttccaaatagggaacaggttacaggttgagattggccggagaagttgtttatagaacgggtaactcggagcaggaaggtatgaggaagttgaccttaagaacaaagaacaaggaagttaaaactttgaagagaaatccattgtatctaacgatttcccccttttgatttttataattatttctcttcagacttgttttagcgtgtcttgattttgttcctcttggtcctctgaaattagaagcttaactgaatgatgcgagggaggattgaggaagattttggtgggtgagagctgttaaaataagcttttgtattaatcctcagatacagggtatgatacagcatcctacaagaatgagcaaacctattctgatggcaggagattgaggacgtaagtcctttccatttgcggaactatttttccattaaaatcgtgaaggggtcatttattccagaatttctagctagctcattggataaagcagtaagtccttgggcctttgttatggttccatcgggagcagtattattagggatgaaagtacaacactgggttccaatcatgacacaaactacacctttctccgctagtatcatgtctaatgctattgtattttctcaggccgtttgactggtgggccctaattgttaaactgttcccttaatagcatccctagtataattaatgaatcgttgctgggttacattttttgtgttttttttgagatggagtctcactctgtcgcccaggctggagtgcaatggtgcaatggttcactgcaacttccacctcctgggttcaacctactctccttcagcctcctgagtagctgggggctgtcaccatgttggtcaggctggtctcaaactcctgatcttgtgatccacccgcctcagcctcctaacatgctgggattacaggcgtgtgccaccactcccggcccaatctacatttttatttagagttgaccaccagaacaacatggattcaaacttgcagctatttgattttgggccttaaatctatctggcactcctcgtgggattccaatggcatctatataaacatgagagtcacgagggacatccattgttttatgatgttctgtttttatgtatgttttctggatgaaataccagggtgaaagggagatagccaattggattagagctcaagtgccacgccaagtaacttggcagagtattcagtaatggtccaccacaacaccaccatacgtttgcttggggatgaataagggacgactgattggtaagctcctggaagggcttaagctcactgcatctcgttaggtctccaagcaaattcaagttctccccctgtgagagacacgaggtaaaattggcattggaagacggatgcttgatggccctcgggggctgacccgcagggtgtcggacttcaggggacttcaggaaacagcagcgagagagtttggcatagcttattgccccaggttgtggggtcttggaagagagctgccatacaacttaatgcctgatcggctggaggacgatccgagtggaaagggaacaatctggggctctggcttaccacgtgcgtaagcataacaatcgctttgtttagcgagcggacagaatgtttaatccattccagccatgcatttgcatctcggtaccgtttcaattggtagagtttgctttagatctttaacctctacaatggtcactttggttttgtcattgggtgtttgtttagaaggggatgaagggggtgggggaacaatgaagcgcatttcgaaagatcctgtagggtctatccctaatgttgcggctcccatgctgtagaagctacttaaagtgggattaggattggtggaggtagaggtaagaatagaaatttgcactgggttacattggtgatattggcaattagagggggccttccctttgaaacgaaggtagggttgtagagagatgcagctttttggggaagtctacccttgaggatcggtattccataggacgtcattccgggatgggcagaacctctcctcaaacccttcccattcccaaactgcaaagaatgtaatggatttagtttcgattaggcaagcattgtgtgaggatttagaatttatcttggaagggcagagatatttttctgagaaggccagttgcctctggttttggagatccccacaggatatgacaagacaggcatcaaatgtgattgaggtgagcttgatctagttacattaatgataaaatagctgacggtagagagaggaaagaagacaaggcagtataagagggttaaagttttcgtagctttaggttggtagaaattggccctggaacaatagcccatgactctgaagatggtgatgctgttttgactggggtatgatgggtccaccccttttcggctgttcgggctgctgtttcagttaggagtgctaggtatggtccttcccaagctggctccttccagcttttgataaggatgtgatctccaggctggtattgatgtaccaggaactgtaagggtggcatctgtgctaaaatacctttagttctgaggtaagagaaagtggaaagccaagtatataatttgatcctttgtttcaaaggtaggaatgtcagtagtaagagtgtaaataaggcagtccacataacagagagataggccagtatctttctgagaggcagtcctgactgaattaggtgaatctgtaaacccttggggtaggactctccattggtactgctgcttccatccagaatgagggttttcccactcaaaagcaaatacttctcttgtcttcagccaagggacatgcccagaaggcatcttttaaatctgttactctgaaccattgattgtcatggaattctgctgaggatggtaaaaggattggggacaacagggtgggtagtctggactatttggttgatagcctggagatcttgtactagttgatgagacctgtctgatttctttacaggtaatactggggtgttaatagggggacatacagggttcagggaatcagtcctgaatgagaacttcaactacaggctttaattctattctgccctctaggggaatgggatattacctttttcttactatttcccctggggtctttaactttgtatggattggagtgacttgaagtttctttttttctttcttttttttttttgagttggagtctctgtcacccaagctggagtgcaatggtgtgatcttaagccactgcaacctttgcctcctgggttcaaacaattctcctgcctcggcctcctgagtagctgggattacaggcgcctgccactgcacccagctaatttttgtatttttagtagagatggggtttcaccatgttggccaggctggtctcaaactcctgacctcgtgatccacccaccttggcctcccaaagtgctggtatttcaagtgtgagccagcaagcccagcctccctgatttctttttcctgcccatacatgaggatgaatgtatttttcttctgcggtggtaagtctcttcctaataagttcgttcctgcctcagggattaacaggaatttaacatgggctgatcaatttttgtatagacctctgtcttttaagatttttgctttaaatcttttatccctgagatagaaagttcttctgaagaacaggtgatagataccagatgggagggaacgggagcgagctgctgctgaatctgtaagaaggttttaagttcacatttgggtcccacctctaaatttatcaggggctcttggtgggactcaaggtaaaagagacagcccctgacctccctattttcctggaaggccataagtggaatattttttctttttcccatttggggcattctcttttgaagtgacctactcttccacatttgaaacatttgttttcccctcttccctgtcctgcactgtgacttccaggttttattcccttactccttgtatacagtttggtcgctggtggcctagagggtttgtaagttttacttccttgtgtctcctactgcagagttctctgttgtaaggtagacagcatgatttttgccttttgtttctgctgctctttgtccctacttatatgcttctctaagaagttagtctctgggacaatctttccaattctctatcttttgtagttgtttttagaggtgtttggccaagtcttagtaacaaaatgaagctttagcatcccttgccccagtgggtcttccatttctaaacctgcatattttctcatctgttctttaagcctatttaggaattcatgggtccttcatccatcccttgtatgttgaatgcttgggaaatactctcagttcgggatactgatggaacattttgaccggtagggtgttaatgttcccagactaccaaagcagccctatggatcatggttcttctcccaagaagggaatgcctaaaatggacataagctcggcccatacaactggggtcctaaaaaatgatttgatctgctaccccataagggtcatctaacaagggcttgagtttttctttttttttagattttgtacttctgagctggttaagggggcatttacgaagctgatgcctcctctcccaaggggcacttcttcaaggggaagagagttgggggcaattctttggaggtggaaaggggaaagggaagttctgagtatcctttttacattgttctatttcatgctgtagggcttaagtgtgtggctagggggaacatggggtattgattcaggattatatgggggagggactgatgagtggggggatcctgtgtaccggcttgatgcatggggtttggcagaggcaagtggtctggtgggtcccatatgttagcaggctgttcgggggtagagaccttactcctttcagaggagttggcttctggcttgcttcctgtagttatgtttagtcctttcactatccttttagcatgagaacctaggggactgtcagaggggatgttactgtcattaatttgatcctttctatttactgtctttcttgaggtattttgcataatgaaggtttggtgtgaggcccaaaattagatttattgcctttcctcataggctcaacctcccttactggagatttcttgccattcctttctctagagggtcagcccctggctactggagatttcttgcactcttctccttttgcttcatccttctctggctgcttcccaggagggaatatttcaggtcctccttagcattggtgtgtcagtataagccccatgacaggaatccaccataagctatacgaggtgaccatggaatcacagatccggaatcatcgctcgcttcgcactcagttgtgcgtctcattgacacactttcaacctctaaaatgccctgaccaccaaggaaatactttgtcgcccctgtgacttttcttaacttggtctgtgcagttacctggtcaccgcagtatgtgaggatcctttccgcctgtgttgctgagagtctgggtttatgtgtcaccttgggtgggacccaatctcctgtttgtgaggccaccgcaaagaggtggtgggatgcctctcctcaagagaggtgatcgtgggcttctcctgaaggagaacggtaatcccagatgagctcccaaattgttggcaataagagctcagagttgcaaagaaaatgatctccaaaagatttctcagcaaggcagatttacttctgcagaatggtgctgcttgcactcctggtcacagtgagagcaccccgaacaaaggaggtgaagtggtttttatccctaacacagctagttcctgcttctgtgttctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattaggtatggagctctctgctcagaagcctccagtgtcttccccacctcacacagtaaaagccaaagtccatcagggcctacatgatcttccccttcccttaacctctaacttcatctcttccctttcaatcttagccacatgggccccctgacttctccattcctttaggattactccaacctcagtatcttagcacttgattttcccactgcctggaatgatcagccctagacccccagagctttgcacagccctctgccttgtgtcattcaggtatttgctctcactccctctggggaactgtctaatcatctctatcactttctattcccttatcttgttttttatttttttaaatagaaactgttgctcaggcgggtctcaaactcctgggcttaagggatcctccctatttggcctcccaaagtgctagaattacaggcatgagccaccatgcctggccatgtttttacttagtgcctaacaggtactgcctatgtgtatagtatatacatgcatgtacatatacatctatgtatatgtgtatatatagtttgtcatacagctgttaagtggcagagcatgcatttgattctgtcagtctgctcttgtatttgtggggtgtttgttttgttttttgagacggagtcttgctgtgtcccccaggctggagtgcaatctcagctccctataaccttcgcctcttgggttcaagggattctcctgtttcagcctcctgagtagctgggattacagaagcctgcacggtgccccttaatttttgtatttttagtagaggtggggtttcaccatgttggccagactggtctcgaactcctgacctcaagtgatccacctgcctaggcctcccaaagtgctgggattacaggcatgacccacgtgcctggcctggcacttgtatttgtaacccttggcttaattgcaacatgttacttcaatgcagtctaatggatacaggaaggagataatttctggctcttaaaagctcaaatgcttttgctggacttctgtgttgatgagataccactgaggtcagaaatggccccaaatacctgccagccaggggccagagaagcttcctggagaactcccagccacacccatagtctcagctttgctgttgcttctctgagctccaaggcagttgtaggcctctaatgatcaaactattggcaacccgtctctagctttagctcctaccagtcccaccaaacatttgatgcttcagtctcgttttacctctttgtcttattgactgaggagtcctttccttctataagcttcagtttcctcatctgtgaaatgaggtttattgggtgcttgccacgtgccaatattgtgctattatctcatttaatctataccccaactctgttattaccctattttatagatagcaaaacaggctcagggaggtttggtgagttcatgtaccttgaaggtggttcttgaaagctgggatgtgaaccagtactatcctaggcccctaatttccaagggcctttgcttaagaccctcaccaactgcatgggtaaaagcacaagcatggccaggcgcggtggctcacgcctgtaatcccagcactttgggaggccgagccgggcagatcacaaggtcaagagattgagaccatcctggccaacatggtgaaaacccgtctctactaaaaatacaaaaattggctgggcgtggtggcccgtgcctgtagtcccagctacttggcaggctgaggcaggagaatcacttgaaccctggaggtggaggttacagtgagccgagattgcaccactgcactacaccttgacaatggagtgagactccatctcaaaataaaaacaaaacaaaaacaaagaaaaacccacacaagcatttctggaaagctgtgggaaaaaataagagattcacaatgtcttccagaattttagctgagaggtggtggtattatctcccccataccccactactcattttctgggaacagagcagttttacaaatggtttggagcttgggcttattcccagctcctggcagacagcagtaacttccccagatctcctatctgtaaagtgggcataacatgtctttcctcctggagttactgtgaggatcaagtgagacaatgtgtcctctaaatgcttgaccacagggttaggtcagtaattgttgcgggaagtcagggaccccaaacggagggaccgcctgaagccatgacagaagaacgtggattgtgaagattttatggacatttattagttctccaagttaatacttttgtaatttcttacgcctgtctttactgcaatctctaaacgtaaattgtaaagatttcatggacttccccaatcaatacccttgtgatttcctatgcctgtctttactttaatctcttaatcctgtcagttgaggaggatgtatatcgttccaggaccctgtaataattgcgttaactacaaaaattgtacagcatgtgtgtttgagcaatatgaaatgtgggcatcctgaaaaaagaacaggataacagcaattgttcagggaataagagagataaccttaaactctgactgctggtgagccgcgcagaacagtcatatttctcttctttcaaaagcaaatgggagaaatatcgctgaattctttttctcagcatggaacatccctgagaaagagaatgtgcacctagggataggtatctgaactggccccaccggggcgtacctgtctcttatggtcgagattgcagaggtgaaataaactccggtctcccatagcgctcccaggcttattaggaagaggaaattcctgcctaataaattttggttgatctcaaaaccctgtctcctgataagatgttatcaatgacaatggtgcccgaaacttcattagcaattttaatttcgcctcggtcctgtggtcctgtgatctcgccctgcctccacttgccttgtgatattctattaccctgttaagtacttgatgtctgtcacccacgcctattcacacactccctccccttttgaaaatccctaacaaaaacttggctggtttttgtggcttgtggggcatcacggatcctaccaacgtgtgatatcacccccggacgcccagctttaaaatttctctcttttgtactctgtccctttatttctcaagccagctgatgcttaggaaaatagaaaagaacctacgtgattatcagggcaggtcccccgataagtaatagtcatcttcatccgagtgaaaaggaataaactagtgattgtgcaacaacttggatgaaccccagagatgcgatgctgactgagggaagccagcctcaaatggttacatgctgtgtgattccatttatttgacattctggaaaagacaaaggtatgatgaagggaagagatgatggtgttgccagaagttaggatgggtggcggatgtggatgtaaagggatcgcacaaggaagtgtttggggtgtcatgattgccgtagtggttatatgaatgtactgggccaggcatggtggctcacgcctgtaatcccagcactttgggaggcccaggtgggtggatcacctgaggttaggaatttgagaccaccccggccaacatcgtgaaaccccatctctccatctctactaaaaatacaaaaattagctaggcgtggtggcgcgtgcctgtaatcccagctacttgggaggctgaggcaggagaatcacttgaacctggaaggtggaggctgcagtgagctgagatcgcaccattgcactccagcctgggcaatagagtgagactccgtctcgaaacaaaacaaaaacccagatttatagaactgtacagcaaaataaaaaaatagttttattgtatgacaatttttttattatttatttttgagacagggtcttgctctgtcacccaggctggagtgcaatggtgcgatcttagctcactgcagcctccaccttccgggttcaagcaatcctcccacctcagcctcctgagtagctgtgactacaggtgcgtgctaccacactcagctaatttttaaatttttttagagataggggtctcactatgttgctggagttgatctcaaactcctggtctcaagtgatcctcctgcctcaccctccgaaagtgctttttaaaaatgttaaaaacaaacataggctctggagctagacttgggtttaaatcccggctctgttatgtattagccattggctcaatcttctttttcttttcctagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacagatttattcacaatttctccatcctaacaagtcagtgatcagttttcacttttccacattcccttctgtccccattatgttcccatagtggggcagcttctacctgcatggttggagcttcccatttttaaagaggcaagaaatcctttaaagttctttgaaatgtttgtagcctgttccaattttataaactgtgaagactgagcaacacacaatgcatgggcctcatatggcctggaggccaccagttggagacctctgtagcttgagctgtgtccctttcagcactgttcttgtcattcctgagctgggatgccccctgaaacataggatgctcagttaaatttgaatttctttttttttttccttgaaatggagtgtcgctctgtcgccaggctggagtgctgtggcgtgatctcagctcactgcaacctccacctccctagttcaagtgattctcctgcctcagcctcccgagtagctgggattacaggcatgcaccaccacacccagctaatttttgtatttttagtagagacagagtttcaccatgttggccaggatggtcttgatctcctaacctcatgatctgcccgcctcggcctcccaaagtgctgtgattacaggtgtgaaccactgcgcccggccgatggcaatcattctttaagatgcagcctccgtggacctcgtaccttctcagtaatttccatattctttgctgacttgggtttttcctccaaaattgtctgggataaattgaggtttgtggagtttcctgatggctagtttccaaactggcttcaaagcctgggcttgtggaattggctgggtctgcggccagcctaacccatccttcggtcacagtctcccatggtcctgatattaattcatcacaggtctgtttagaaggtggcagaaacagacggtcttgggcttatttatatctgtggctttttttaaaagacagaaaaggagaaatctggatcctttccttgtcagcctcctttaactaaatggtcttttgctaaaatagactggccccactgtgtgggtaggaagggttgagatgggagtgggccaagtgagtgagaactttttttttttgccttgatgttaaaatggcagcatgtgcagtcttctgcctctgcccaggttgacctgatgtttttacagggagagaggctgcttgttgagtgtggtggtatttatcatagtgtatgttaggctgcctcaaacatccctcgctgtcgtacctttcagccaactctaatgtacctctctcagcctgatttctccccacttgagttataataacaacaactgccttttaaaaaatttcctactgggcttcatgctaggtactttccacgttttatttttatttatttattttttgagacagagtctcactctgtcacccacgctggagtgcagtggtgtgatcgcagctcactgcagcctcaaactcctgggctcaagcgagcctcctgcctcagcctcccgaatagctgggactacaggtttgtgctactgtgcccggctaatttttctatttttttgtagagacagtgtctccctttgtttcccaggctgatctctcctgggctcaagcgatcctcctgcctcaacctcccaaagtattgggattactggtgtgagccaccattatatgttttaaataatttattcctcacctcaagtgagtgaggtaacatcccagttttacagacaaggaaacagattgggcaggggaagtgacttgcctcagatgcacaataaatggctctgccagtgtcttccttagcgcctccgatccccttctcacccttgtcctctctgctcctctctgctcaatgctcctgggagcgtgaactgcattaatggctccttgtctggtggcctcaaggttccccaggaggcagggagggtgaggctgagatgtgtgctcccctaaggcacatgcctcagcctggctgcctctgtctaaggccacagcccctcaagtgcttccccacctgactttctgggctctggtaaccgcttcctgcctgccccatcaggtgtagggggtgcttcatgggtcaacattagcttatgtggtttccttatatcctgggcgcacctttgttagtctcaaattacattctgcttgaactattctctatccagtgggttgtgactatctagaggcagagttgggatttgaaccccaagacttcaaaataagctctgtgcaaatggcctcccagagctgcctgctggtttcttctgcgaggcctggcttctccattttggcttggaccatggcctgctgtcatttccacaacagttgcaggaagttgccaaatgcgttttctgtgactgccaggctggtgaccctgttaaaaacaaagcaacaacaaaaaaagcaatttcttcaattaaaattacaaaacagaaaaaaaaaaagatgtcacacttgggggaagctggttgaagtgtacttgatattctacatactattttcgcagttctctgtgaatcaatagttatttccaaataaaatgttaaaaaaaactttattactaaatcagaaaaaaacaacaacaaacaacaacaaaaaccaaagcagaatatgtggtgcactgttgagggaagtacagaaggataaaaacaagaaaatactgacacaactcagactccactgttgaaccttattttattttatatacttctaggtcttttttttttttttttttgagaagagtctcagctcactgcaacctctgcctcccaggttcaagcgattctcctgcctcagcctcccgagtagctgggattacaggtgcctgccaccatgcctggctaatttttgtatttttagtagagacggggtttcaccatgttgtgcaggctggtctcgaactcctgattcaggtgattcgcccgcctcggcctcccaaagtgctgggattacaggtgtgagccactgcgtcaggccacttctaggtctttttctacatgtttatatatacactgtatgtattctttaccaaagtgggatcataccataatgctgttttttttttgttttgttttgttttttgtttttgtttttaagacagtcttactctgtttcccaggctggaatgcagtggtgtgatctcggctcactgcaatctctgcctcccaggttcaagtgattctcctgcctcagcctcccgagtagttgggactacaggtgcccaccaccacgcccagctaatttttgtatttttggtagggacggggttttgctgtgttggccacactggtctcgaattcccaacctcatgtgatccacctgccttggcctcccaaagtgctgggattctaggtgtaagccaccacgcccggcctatagtgctgttttgtaacctctgtcagttaaccatctccattttttcacatcaataaatttcccatttgtccacaaaagtcctgtacagctggcagaggatatgtgtgactggaggccattaggtccttcaggttcttccagcctagcaccaccctttcttcccctttaccataggggcttgtcctagagaacgtctcaccttctggattcatctgagtgttgccttctgggggtgtcacttcatttgttcctctgtatcctgcatcccctgtaaattggagagtcaatctaaagttttgataagatcaagttaaatattttggcaagaaagcgtcatacatgatgatgctgggcacatcaggtgacatcacattttatatttaatggacaaataaaagttgtatatatttactgtgtacaacacgatgttttggaatatgtatatgttgtggaatggctaaatcaagctaattaaaatatgcattacttcactttttttttttttaagagacagagttttgctctcgttacccaggctggagtacagtggcatgatctcggctcactgcatcctctgcctccagggttcaagcgattcttctgcttcagcctcccaagtaggtgggattacatctgccaccatgcccggttaattttttgtatttagtagagacgggtttcaccattttgctcaggctggtctcaaactcctgacttcaggtgatctgcccccctcggcctcccaaagtgctgtgattgcaggcatgatacttcacttattttttgtgataagaacacaaaatctcttgagcaatttttaagtacacagtatattcttattgactatagtcaccatgatgtacaatagagctcttgaagttattcctcttgtttaactggaaatttgtaccctttgatcaatatctcctgaaaacaattttctctgcttctctcttatgactttgacttatatgtgtagatgccacatagaagtgatatcttccagcctgggcaacagagtgagattctggttttgtttgtttgtttcttttttttttttggagacagtctcactctgtggcccaggatgatctcggctcactgcaattctgcctcctgggctcaggtggtcctcccacttcagcctcccgagtagctgggactacaggcatgcaccactacgcctggctaatttttgtatttttttgtagagatgggttttgccaggttgcccaggctgatcttgaactcctgggctcaagcgatctctgcctgcctaggcctcccaaagtgctgggatttcaggcgtgagccaccatgctcagctgagactgtttctaagacagtctcactctgttgcccaggctggagtgcagtggcgggatcttggctcactgcaacctctgcctcctgggttcaagtgattttcctgcctcagcctcctgagtagctgggactacacgtgcccaccaccacgcccagcgaatttttgtatttttagtagagacggggtttcgccatgttagccaggctggtcttcaactctcgacctcaagtgatccacctgcctcggcctcccaaagtgttaggattacaggtgtgagccaccatgtctggcctcacacagaattttaaaaacacattttaaaagtgtattcaagggttgacatgcaatagaattagcaatttttactgctttatcaaggacattcctaagtgaaactggctctcttcttgttactgtgggcttgtaggggtgaagaatacagtgattactaatagaattaggtgccaccactttgattcatgctaaggagccagcagctttgtcctctgttgtttttgtaccatttaacgcaaatgtcacaggggaatgttaaaagataaagtcttactatcattatgaaaattcttggccgggcgcggtagctcacgcgtaatcctagcactctgggaggccgaggcgggtggatcatgaggtcaggagattgagacgatcctggccaacacggtgaaaacccatctctactaaaaatacagaaaattaggcgagcatggtggcaggcgcctgtagtcccagctactcaggaggctgaggcaggagaatggcgtgaacctgggatgcggagcttgcagtgagccgagatggcgccactgcactccagcctgtgtgacagagcgagactccacctcaaaaaaaaaaaaaagaaaattcttttgaccttgcagccccctgaaagtgtcttaaacaccatactttaagaatcaccaatctgttctatagacttcattcaaatgttgccaattttcctactaatatccttgttatggtctaagatctaacccaagagcacatttaaaaaaaatatcaacttttactttagattcaggcggtacacatgtaggattgttacaaggatatatttcgtggtgctgaggtttggggtatgattgagcctgtcatccaggtagcgagcaaggtacccagtaaggggtttttcaccccctgccccgtccctctcttccccctcaagcctgtcatccaggtagtgagcaaggtacccagtagggggtttttcaccccctgccccatccctctcttccccttcttgtagtctctggtgtctaatgtttcatctgtatgtgtccacgtgtacccaatgtatagctcccatgtgtatgtgagaacatatggtatttgtttttctgtttctgtggtaatttgcttatgatagtggcctccagctgcatccatgttgctgcaaagggcatgatttccttcttttttttttttttttttgagacacagtctcgctctgtcgccaggctggagtgcagtggggtgatctcggcttactgcaacctccgcttcctgggctcaagcgattctcctgcctcagcctcccgagtagctgggattataggcatgcgccaccacacctgactaatttttgtatttttagtagaaacggggtttcttcatgttggtcaggctggtctcgaactcccaacctcaggtgatccaccaacctcagcctcccaaagtgctggggttacaggtgtgagccactgtgcctggggatttcattttctttcagggctgtgtagtattctgttgtgtatatgtaccacattttctttattccactgctgatgggcacctaggttgatgccatgtctttgctattgtgaacagtgctgtgatgaaaatacatgtgcatgaagagctaacgtcgaaacatgttctatttagatgtcctctctccttaggctctctctctctctttttgaggcagagtctcactctgttgcccaggctgtagtgtggtggtgtgatttcagctcactgcaacttctgcctcccaggttcaagcaattcttgtgtttcagcctcccagacattaaagagatttacaggccaggcacagtggctcacacctgtaatcccagcactttgggaggccaaggcgggtggattgcttgaggccagaagttcgagaccagcctggccaacttggtgaaagctcttctctacgaaaaacacagaaattagccaggtgtggtgacacacacctgtaatcccagctactcaggaggctgaggaatgagaatcacttgaacctgggaggcagaggttgcagtgagctgagatcgcaccattgcactccagcctggggcaacaaagcaagaccgtgtctcaaaaaaaagggatgggaaagaaaattgaaaattactagagggttactttgattacagtattcagggaaggcctctctgaggatgtgacatgtgagccaagatctgaaggatgaataggagctgggcacaagaaaatctgaaagggaagagcattctgggagcggagacagaaagtgcaaaggctcagagatgagaatgaactcggcaacactacacagaattctgtccaacattcttcagctgctgaaaaacttgttcatgataaacttgggactcagacacatataacagacatcagttaaacacttatcagagctggagtcatgttaaagtagaataaaaatgtcaaactccagacatttccataaacactcaacatgcttcatttgcttaggaggaattttcctcatctctaaatcatggggttccagtttcccaaactctctgccaggaagggaaattgagctggaaagtgaaccatcagagaaaattaagcacccggctccaccctgagctttatcatttatcagtggagtcagctagacatttggcagaaaacggtgaaaataacatttgcctgtgtgtctaatggttccatatgcgttttgggttgggtggcatccagaagcagctgggaaaattccagttgtatcaggcattcatctcttctctctgtggctagccactcaggaagtcacatgggtaccttactgctccctaatttagctctgtctttaaaaaatatataaaaatgtttcttttttttttgagatggagtcttgctcttgttgcccaggctagagtgcaatggcgccatcttggctcactgcaacctctgcctcttgggttcaagcgattctcctgcctcagcttcccaagtagctgggattacaggtgcccaccaccatgctcagctaattttttgtatttttttagtaaaggtggggtttcaccatgttggccaggctggtcttgaactcctgacctcaggtgatccacccgcctcggcctcccaaagtgctgggattacaggcatgagccaccatgcccagccaaaaaaatcttccttaagatataaacacacacaaaaggcaaaaggaaggcaacttgaggaagtggctagatcaccatattgaacttcacagaatctgggttcaaggcccatttcatgcactaactgactcagccctctcatttgtaaaaatttacaccagtttcttacaaagtggcaggtactttttagctgtgtgaccttaggcaagtgagttcacacctctgagccttgacttactctgaaaataggcattaataatacttatttgtggtagacactgatggtttctacccaacagttgttttcccctcctgggtctttgcttccttctcccatgacagaagcagatgtggccagaccttcaccttcccaacctcctctgcagctaatgaatgcagcctagttctggccaatgagatgcatggaaaaattggctagggagcttctgtatgtagtgcctgtgattttttgttttcacatgattaataatatgatttcatgcagctattactagatggggccaggcgtggtggctcatgcctgtaaccctagcactttgagaggctgaggcggcgaatcacctgaggtcaggagttcaagaccaccctgggcaacatggtaaaaccccatttctactaaaaatacaaaaattagctgggcatggtggcacatgcttgtaatctcagctgctcaggaggctgaggcagaattgcttgtgcctgggaggtggaggttgcagtgacccgagatcacgccactgcactccagcctggatgacagagtgagactctgtctcaaaaaaaaaaaaaaaaaaaaaaaaagtacctggggctaaatagaaaggcccagaaaatccaaagcatgtgttctgctgtgtaagttggagcagtgcttttggatgcttctcagctaaaaatgcagattctggttcagtaggtctgtggtggagcttgagagatgttcctaaggaggaccatttagggttggctgatccaccatttcaacaagttcttcaagggctcaagatctctcccacttttctccctgccatcctggatggttggtgtgctgtccccaggcttgttgtgtgaaggtcacaaggtcaaggacacaatgccagcgaccacacccagacataactgaactttcaaaggaagaggagcatgtacccttccaggcatctctctatcagtggagaaatctttccccaggagcccattcttctgacccccacccctcaccccagccaatggctgccgtgtggcacaagccaggagtaccattttaatagactctctgggaatgttgtcccagaagttctagcagccttctcctcacatcttattagccagatgtgtgtcgtgtgcttcaagcttaagccagtcattggcaaggagagtagaatgactgtgactggctcaggccagaagtctcaaagtgaggtgctgggaccagctgtacctgcatcacatcgcctgggaagcttgttagaaatacatattttaggctgggcacggtggctcacgcctgtaatcccagcacttcgggaggccgaggcgggtggatcacaaggtctggagttcaagaccagcctggccaacatagtgaaaccctgtctctactaaaaatacaaaagttagccgggcatggtgatgcatgcctgtagtctcagctacttgggaggctgaggcagaagaatcgcttgaacctgggaggcagaggttgtggtgagccaagatcatgccactgcactccagcctgggcaatagagcgagactctgtctcaaaaaaaacaaaaacaaaaacatattttgggcctgcaccccagacctactgaattagaaagtctaggggtgaggcccagcaatggattctaacaagggctccagataattgtgatacacactagaattggccctggctgcgcattggaattatccaaggaactcttaaagctaccgctagatagacgtcagaatggtggttacccctgcaggctgcactggagtatagaccctgaagtagtgtgaccaacttgtggtttgcttgggagtttcttggttttagtactgaaagtcctctgtcctggaaaatcccctcaatcctgggcaaattaggatggtttgtcaccttaccttgatggagcaagagggaattttctggggtgttgaaaatgttctatcccatcatctgggtggtggttgcatgtgtgtacgcatgtgtaaaaaatatcaagctgagctgggcactgtggctcgagcctgtaatcccagcactttgggaggacaaggcaggaggattgtttgagcacaggagtttgagatcagcctgcctgggcaatatggcaagaccccacctgtactaaaaataaatttaaaaaaaactttagcattagccaggcatggtgatgtatgcctgtaggcccagctactaggcaggctgaggcaggaggatcgtttgagcccaggaggtagaggctgcagtgagccatgatcgcgccactgtgcttcagcctggacaacagagtgagactgtcttaaaaaaaaaaatcaagctatccgtttaaagtttgtgcaccttacacatgctactaagtgtacatcacaacttaaaaaaatactgatgtccaggttgtattccagattgattaagtcaaaatctctaggagaagatcccaggcattggtatcatggaatactctccagacgtttctcacgttcagccagatttgtgaatgaacacgatcaaatctccagggagttaaagtgaaggttctgattcagcgggtctgggtgggcctgaaattgtgcatttccaccacactcccaggggatgctgatgctggaccatgctctagggagcgagggccaggcctggttaacgtttaccttctggggcaggcagagggctgctcccctgaaacatcttggtggtcttagtgaggaaggaagaaagtggggctcattggagactagctgtggggtaggcaactcccgtggcattcaaagaattaaaggttagggtgaggttagaagcttacacctgggcaaccatacaaatgcaaaagctcagacatctgttcccaactccctgatgtgccaggagggccatgtttgcctaggttttggctctacttcctagccagagtcaggcctgaatacccagcgtgggcttagtttgcttctcctgaggttactcaggaacctgtctttctggagaagccagtgccatgtccagaggtgccctcctctgcgctgcagacaccacggagactgataacagggctgccagctggtttaattacccagatgggaagctggcaggtggagtctaaccttgacagagattaatgactccattatcttcctaggctatcatcccgtgcgggccccagtccggaatgtagacataaggtgtaaataaagtccttgttctgagggaggacatttttcattgtcttcagatgggaatttgcccccagaaacccttgactcaaattcgggaagtatctttttttggcagaataacctggtcgtttgtgggcatgtgacaggtctcctaaaggctgggccaaggcttgctggcaaaaccaatgttacttgtttccttaaactcattaagaaatacgtgcctgttgtaaacaacttaaagtgacagctcttgtctcctttcccactctttgaaggtaactattatacttaactctttggcgtatagtcttccaaatatatttctttttctgtttgttttcttctccagataaagtttccccccaaattttattggggcataattatagtacatttatttatttatttatttgagatggagtcactctgtcgctcaggctggagcgcagtggcacaatcttggctcactgcaaccttcacctcctgggttcaagtgattctcctgactcagcctcccgagtagctgggattacaggcacctgccaccatgcccggctaatttttgtatttttagtaaagatgaggtttcaccatgttggccaggctggtcttgaactcctgacctcaagtgatcagccctcctcggcctcccaaagtgttgggattacaggacttgagacactgtgcctggatggtggcacatatttaaagtatataacttgattggtctttaaaattattttattatttgcagagataataaatcttccttaataaataaaacaatcttccttcctcactttgttgcctagggctggtctggaactcctgggctcaagtagtcctcctgccttggcctcccaaggtgttgggattacagacatgaacctccaagcccagccccaatttgattactctttttttttttttttgagatggagtcccactctgtcgcccaggctggagtgtggtggcatgatcttggctcactgcaagctctgccttcccggttcacgccattctcctgcctcagcctcctgagtagctgggactacaggtgcccaccacgcccggctacattttttttttttttaatatttttagtagagacggggtttcaccgtgttagccaagagggtttcgatctcctgacctcgtgatccgcctgccttggcctctcaaagtgctggggttgagccactgcgcccggcctattattattattttttgagatggagtcttgctctgtcgcccaggctggagtgcagtggcgcgatgttggctcactgcaaactccacctccctggttcacgccactctcctgattactcttgacatagacccattaaaccatctctccaactaggatagagcacatgtccctcacccccaaaagtttccatgtgtccctttgtgattccttcctacctgcatcccctccactactgaacaacaactgtcactataaattagtttgcattttctaggttttatggaaatggaattatgcagcatatgtatatgcttttgcctggcttctttcactcaacataatgattttgagattcatctatgttgtagaaatcaacaatatgttgcttttaattgctgagtatatcccatggtatggatatatcacaatttgtctatccattcatctgtggatggactttttaagttgcttctaatttatggtgattacaaataaagctgctctgaacatttgtgtacaaatctttgtgtgaacagatattttagcttctcttaggcagatacctaggagtggaaagactgagtcatgtcacatggtaggtacatttaacttttcaagaaactaccgaactgttttccaaagtggtttatctcattttgtgttctcaccagccctgggtgagagttttatgcgctccacatcctcaccaaccctgtgatgatcagtctttctaatatttgccattctaatgagtgtgaagcggtatctcattatgattttaacatgcatttccctaatgtctaacgctattgagtatctttttatgtgcttattggccatttgcatgtattattttgtgaagtgtctgttgaaaattttgttgctctttcttttattgggctgttttcttattgttgagtaataagggttctttatatatgttaaatgtctaaaatgctacattttaatatagtggtgtcctcaaagtgggagtgatgaattttatctaattttgtcatggtcaggggaggagttgtgctctggaagcccatccatggggaaggtgaggttcaaactctaagataaaaactctagataaaattttaagtcctgctgtggatggctgttgtttctttctgcccagcatttacaccttttctgataacaactcaccccaatgttttcaagggagaattattcttccaccatttttagtacctgcggtttgggtgaagctgaccctaaaccctggctcctggggaggggtatgaccttggcctggccaatcagcattttcatcttcctggctctgtaatgtgcatgtaactcagatggatccaatgggattcaactttaggacttttgctggagtgactctttgtattggtctcagcttcctcctcagccacctccttcctcagccacctcctcagagaagccctccctgacttgcagaagagatgaggcatctctgatgtgctcagttagctcgctgatctttcatgcacagcacttatcacagctattaactaaatatttgtatgattatctgtgtaataaatttctgccctccagactgcaagctccatgaaactggggctgcatctcttttgttcactcttgagtccccagcattggtatagcctatccgtatattttgaacgtgaagatgacaggatttgctgaggaattggatgcatgctggatgtgggagaaatagaaacttgagacttaataaatacttgttgagtgaatgtaggaagctacatttgtgcatgagaaaactgaggtccagagaggtgaaatgactctccccaaatcgcacagcaagtcaggagcagagctggaatgtgaattcggggctgtccaacttcagagcttgtgctcttcctcagcaccctaaatgactccttgcaaactgaacataattttccacaacaaacactgcttaggcatggcagatacctctgaaataaactgtgttatttatctattgcttcataacaaattacttcccaaccttggtggcttgaaacaacatttattaactcatgatttctgtaggttgggatccaggtgtggcttagttaggtcctctgctttggggcctctcataggccacagtccaggtgttggctggggctgcattctcatcttaaggcttgactggggaaggatctgcttagggaaggatttgcttccaagctctctctcttttttgttggagggattcagttctgagggttcttggttgaggtccattccttgccacatgggcctgtcccttgggcagctcacagcatggcacctggttttatcaaaggagtgagtgagtgggaaaaagtgagcagaaaggaagtcatggtatcttgtagcctcatcatggaagtgacatcccatcatgtttgccttgttctattcattggaagtgagtcactaagtccagcccacacttcagggaaggaaattacataagtgaaaacaagtttgtgaatgcccaggtcagtgggagtcatctgagaagcctgcctaccacttaaactaagtctctttctcatgtagcttaacttctggtcaggggaagtgcacaaaaagcaaacaaataaataaaaatataacacatcagatgatgctaaaatgcttgcagaaaatcatgtggaggaggttatggagggctgggtgcaggaggagactaagcattcttactttatatcaggtggtccgcagagacctgggtgagagggagacatctgaatagagagctgaaggaaatgaaacaacaagccaaaaggatacgggaaagagcattccagcagcaagaacagcaggagcaaaggccccgcatcacaaacctgcctgaagtgttctaagaacagcgaaggtcagtgtgactccagtgatgatggcaagagagagagtaccaagtcatggggttagagagataacagggcggccgggcatggtggctcacacctgtaatcccaccactttgggaggctgaggtcaggagtttgagaccagcctggccaacatggtgaaacctggtctctactaaaaatacaaaaattagccgggtgtggtggcgggtgcctgtagtcccagctactcgggaggctgaggcacgagaattgcttgaacccaaaaggcggagattacattgggttgagatctcgccactacactccagcctgggtgacacagagagactctgtctcaaaaaaaaaaaaaaaaaaaaagcgataacagggcgtcgggtcatgtaggcccttgtagggccactgagtgagatgatgagaaaacattagaagtttctgagcagagaagggatgtgatctgacttaaatttaatagagtccctggctgctggttggaggacagaccttgggagacaaaggtggaagaaaacaaattatgaggtttttttttacctggttcaagtgagccatgatggatatttgaagaatttgctaagggtgacaacacagaggaatccaggccaactacaagatattcggcctgagcaactggaaagatagagctgctagtaactgatttggggaaactttgtaaggtgaacattgactgggagcaaaggatgaaaggcccctttattttattttattttattttatttgtatgtgtgtgtgtatgtgtgttatttgttttgttttgttttgtttttttgagacagggtctttctctgtcactcaggctggagtgtggtggcgcaatcatggttcactgcagccttgacctcccaggctcaagagatccacctaccttagcctcctgagtagttgggactatagatgcatgccaccacacctggttaattttttaatttttttgtagaggcaggatctccctatgttgctcaggcaggtcccaaactcttggcttgaagtgatcctcccattttggcctcccaaagtgctggaatcccaggcgtgaaccaccacacccggctgaaaggtggctttggcgctgctaacatcaaggtccctgtgagacatccgagcagagatgccaagttggcagttggagactagagtctagacttcacgggagaggtccaggctggggatgtaaactcagaagttgtcagtttattagtgtttagagccatgagtctggatgagatgggagagagagaagaggcccaagcctgagctttgggcacttgattaattcaaagccacaagatgaggaagaaccacctgaaaagactaagaagttgtggacagtgaggtaggaagagaactaagagaagaaagtgctgaatgacaagcagcatcatggtagctggccatgggaaatggcccgccaaaaactgcacactgcggttcacactcttgctcggccccagccactttcctctgggctgtcaccatagaactaacaaaaagcagcagaagtggcagcctgccttctgaggccaggtcacaggaaatcttgcagcttctaccttagtgtttttgaatgctgctctgggataagccagttgccatcaaagaagtttgactactctgagccaccacgatgtgaggaagcccaagctaagcatgtgggaagcccaggatggagggaaaagatggccaaccagggccatggttgttccagccatctcagctgaggcaccagccacaggagtgaagaatttgttttagacatccagtccaatcaaaccttgccatgactttggctacagctgcaccagcatgagaaaccctgagggagaaacccacaggactaggagagacagtgacacactgtcattttaaggctctatattctgggatggctcattctacagtggataatggagacaggagttcattgcaaagggagactgaccagtcccctgcccgcaacagagcacagccctcttcacccagacccatggagaggtggctgagcagacctcagctgggcagccctccacactctgaaggctccccctttcctgccttagtggcaagaataataattttctctttgtgcccagagagctggcaactgccaagtgccctgctgtccccagggcccttacaaaaagactgcaggggaggtttttctgagaactgggtcaccggttacttagatgcttcaaacctggcagaacagagaaacatcagataaaggagactgggaacttcataggaagctgctggtccttgtcatggggacacaccatgacaagccaccagagagtggctgcctgccctctctggacccttatgtcatagggacctcctctcttctagagagctctctctttctttgtaaatgtttgtaaatctttctttgtaaacattttggaaagtatgcattaatcaggccagacacgatggctcacgcatttaatcccagcactttgggaggccgaggcgggcagatcactcgaggtcaggagttcaagaccagcttggccaacatggtgaaaccctatctctactaaaaatagaaaaattagctgggcatggtggtgggcatctgtaatcccagctactcgggagggtgaggcaggagaatcacttgaacccaggagaaagaggttgcagtgagctgagatcacatctgtaatcccagcactttgggagtctgaggtgggcagatcacttgaggccaggagttcgagaccagcctggcaaacatggtgaaaccctatctctacaaaaaatacaaaaattagctggatgtggtggcacatggctgtagtcccagctactggagaagctgaagtgggaggatcacctgagcctgggaggtccaggctgcagtgagccgtgattgtgccactacactccagcctgagtgacagagtgagaccttgtcttgaacaaaacaaaacaaaacaaaacaaaacagaaaaaaacctgtccttttctcccactgcctgttcagttccccagaggcaattgcttaacatttctttcacatttattggaataggtaacacaaggcgtgtgctaaaaatttcaaaaggtacaaaaaaggtaaagagattaagtctccctccttccttctccccacccagctcctctccctaaagacaaccacttctaccagtgtattacatctccttccagagatatgctatgcatatgtcagcatataatataaacagccttaaaaaataaaacagggctgggaatggtggttcatgcctgtaatcccagcactttgggaggccacggtgggtgcatcacctgaggtcaggagttcaagaccagcctgaccaacatggtgaaacgcttgtctctactaaaaatacaaaattagctgggcgtggtggctcatgcctgtaatcccacctacttgggaggctgaggcaggagaattgcttgaacttgggaggcggaggttgcagtgagctgaggttgtgccattgcactctagcctgggcaacaagaggaaaacaccgtctcaaaaacaaccaccaccaccaacccagaaagggtaacttgctacaaatgctgttctgcaccttgcttttccacttaaccatatattttgaaggtcttccatatcagtaggtaaataactgctttattattttaggggactgcacaatattccactgtagggatggaccgtaattcatgtaaccagcccctactgagggacactgaggttgatgccaaccttttgatattacagtgaaacagcaaataatcttgtactcatgttttcttgcacatgtatgcctctctcagtaaagattcctgaatcaaaagacgtgtgcttttgtcattttttaaaatttttatttattcatttatttttgagacagggtctcgctctgtcacccaggctggattgcagtggcacgatcatggctcactgtagcttgacttcccgggctgaagtgatcctcctgtctcagcctcctgagtagctgggaccacaggtgtgtgcccccatgcctggctaatatttaaattttatttttagtagagacagggtcttcctatgttgcccaggctggtctcaaacgtctgggctcaagcaatcctcccgcctcagcctcccaaaatactggaatcccagtattataggctgtgcttttgtacttttaataggtattgacaaaatgagactgtattgatgttcttgtttgcagacttcatacttaagtgcccctttccctacaccttccccaattctattcaaataaaaatcaacatctttaatctgtgctgtagaattggtaagaaatgtatctctgcacttttacatttgaaatatattgttagaaggttgagcatcttcatatgcttaattgtcatggcaaccacttctagcctgtgtagcgatttcttctagttgtttatttccatagagctaaataatgtttgaatgtagccattcattgatttatcagctttaggtgttatctattgatttttgctccaatacatgaggatttagctcacttacagtgtcatccttgcacctcctctatctttctacccttccttccttctctcttttttatttttattttttttttgagacggagtcttgcttgttgcccagggtagagtgcagtggcacaatcttggttcactgcaacctctgcctcccaggttcaagtgattctcctaccacagcctcccaagtagttgggattacaggcgcccactgccaagcccagctaatttttgtatttttagtaaagatggggtttcaccacattggtcaggctggtcttgaactcctgacctcaggtgatgcacccacctcgtcctcccaaagtgctgggattacaggcgtgagccaccgtgcctggtctcttctctttatgaaaaatattgctggttttccatttatagtagtgatatatttttttcctttccttttcttattaaaatagactattttttagagaagtttttggttcacggcaaaattgaacagaaagtacagagttctcatatattccctgctcctcccacccctcagtttttcccactaccaaggtcctacaccagtggtacatttgttacaatcgatgaacctgcactgatacatccttatcatccaaagcccatagtttgccttagggttcactcttggtgctgcacattctatgggtttggacaaatgtacaatgacatgtatccaccattatagtatcatgcagaatagtttaactgccctaaaaatcctctgtgctccacctattcatccctccctccagcctaaccccaggaaaccactgataattttactgtcttcatggttttgctttttccacaatgtcatgtagttggaatcatacagtatgtagtctttttcagattgtcttctttcagttaataaaatgcacttaagtttcttccacgtctttttgtggcttgatagcttatttctttttagtgctgaataatattccattgcctggatttaccacagtatatttatccattcacctcctgaaggaaatcgtggttgctcccaagtttggggaatcattaataaaacttctaggaacatctgtgtgcaggtctttgtgtggacataaattttcagctcatttgggtaaataccaaggagcatgaatattggatcatatggtaagtgtacatttcattttgtaagaaactgccaaactgtctcccacaatggctataccattttgttttcctaccagaaatgaaaaagagttcccgttgctccacgtcctcaccagcgtttaggattttaatcctttgaataggcatgtagtgttatctcattagtattttcatttgcaatctcctaacgacaggtgatgttgagcatcatttcatatgtttatttgccatctgtatatcttctttggttgaggtatctgcttagttcttttgcctattttttttttttttttttttgagacggcgttttgctcttgttgcccaggctggagcgcaatggtgcaatcttggctcactgctacctccccctcctgggttcaagggattctcctgcctcagcctcctgagtagctgggattacaggtacccgccaccacacttggctaattttttgtatttttagtagagatggggtttcaccatgttggtcaggctggtctcgaactcctgacctcaggtgatccacccgcctcggcctcccaaagtgctgggattttacagacctgagccatggtgcctggcctcttttgccaattttttaatgaggtcttttgtcttcttgttattgagttctaaaagttctttatatattttggacagcagttctttatcaggtgtgtcttttgcaaataatttttcccattctgtgggtttggtgggtttgtcttctcattctcttgagtgatgtggcatttaaaaaaataaaattactttaagtttaaaaagcaagtccatttaaagagaaacacccaggaaataatagccaaggtggtagaatatggtgaaaaaatgaaagggcacccaagagcctcaggtttgggcaatactgatgacacatagagcctggttccctggcaattattatggcggttactactattttaataatattagcagttacggttggtatttttgctattacaattaatggcataggggctgtatcgcccctgtcttcctggaacctggaggcaatgaggagctctgcaaagttgttgagattattatgaccatatctgggtatttcaccactacaaagagctgcgcaaagtttggacggtaggaatcggggtggacatcagctcggtgacaggtaggaggtgggtccgaggaggggtcgggtctgggagcctccgcccccaactcaaggcaggctacacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattccaaaactagtgtgtccaagctggttagaactcaggcaggcgggtccagaagccgaggggcctgacagatacgcaggtgaagtccatctgtggtccgcgtgctgggcgtggccaccgggctagtccaagcattcctggtaaaggctcctccagagtggtacccacagcgctctattaagggctattttagttgagtcattagtgggaaggacgctgcctatcccctccccccccgccaccccactcccttcttctagagatggagccttgctctgtcgcccaggctggagtgccgtggtgcgatcatcattcactgcagcctcgaactcctgggctcaagcgattcttctgcctcagcctcccaagtagctggatgacaggcacgcaccaccatgtctggctctctatcctttttaaatcccagaagtaaagttttcacacccactggagacaaaaaaaaaatctaaattctgtcaccctgtaaaacggttatgacccaactttcctatgtcagggaggaaagtgattgattgggcccctctaccgtgtgatatcactagagcttccttcagaaatttgttttaaaagacagagagggcgcttttaaaaaaatgcataatgggtcgggcacagtggctcatgcttgtaatcccaacacttggggaggctgtgggaggatcatttgaggccaggagttcgagaccagcctgggcaatattggaagacccagtctctacaaaaaattaaaaaaaaattagcctcaaatggtgatgactgcctgtagcaccagctactcaggagactgaggtgggagaatcacttgagcccaggaggttgagcctgcagtgagctatgattatgccactgcactccagcctgggtgacagagcgagatcatgtctcaaaaataaataaataaataaataaataaataaaaatgtaagggacctaacatccattaatcacctatccctctgtgcccagaagctgggctggatgtcccctggaacctgaatacattctccctgccctctggggttcaggtatggaataacatccctgtttagcagtcaagaaaagcaaggctcagagaggagagggctttgggcagtcaagaattcccagccagtggaggagctgggtctgattctgagtcttctagctccttgctgccaggagtggccaacgttggaaattcaggcagcagtgagatgagaaagtaattttggatgtggtgtcttctcaagccataggcaaaagagaactccttccagattaaatttggggaaggactgcctgggggtgcttttgtactggttggttttctgtgtagagagttcatgcagccgcgggtctgtactgattggagctgaagtcccaggttagcaccaccaacaggggctcccctgccacagcgcaggagtgggggcccaggatgggtccaggcaaaggcatcagtgatactttctcatggtctgaccgacacccacagaatcacacaatgttagcccctcccaagagatgtcctttctatacggagtgggggctggaggaaccaggagcctcaaagctttgctttcacctttgttttgctcttttgggatctgcctccttatctggagcagggtcttgtgaagagacgcagggaaaagttcactttccacctcccaggggagcaggcaggaggggactagttaggaggcaaaagatgtagagaagtatttgcttttttcatgggctatttttaggagataaagtcaactgccttaagtgatcaattgtaatagagggagatgttgaagatgacttaaaaaacaaacaaaatccgcaaacaacaaatctaatatttatgaaataccaaatgtcaggaaggtactattttaagtgcttgaagtaaattgtctcatttaagcctcataataacgctatggaacagtgttatcatgtctgttttacagatgaggaactaaggcacagagaggttaagtgacgtgttctgggttgcacagctcttaaacagcagatctgggatttgcactccagcagtctgactccagatctcaatattgtatagcagctcaagggtggcagagactcaagaatgttaggagagggaagcttgagtctacaggtgtaaggagaccccttgacatcttccccatttagttcaattaaaattttctttttttttctttttctttctttccttccttctctcttttcttttctttttctctctctctttcttccttcctttctttttatttttcagggtttcactgtgtcacccaggctggagtgcagtggtgcaatcatggctcactgcaacctctgcctcccaggctcaagtgatcctcctacctcagtctcctgagtagctgggactacaggtgtgggccaccacacccagctttttttttttttttttttttttttttttgtattttttgtagagatggagttttaccatcttttccaggctggtctcaaactcctgggctcaagctatcctccagccttggcctcccaaagtgctggaattaccagtgtgagcctccacacccagcctcaattacaattggtggccaccttctgtgtgcccaattcagctagaagcactgggggatggaagcaaggctggagttctggtacccctcaagcttattgtctatttttgggagacaaggtagttgggaaaggaataaataatttcagtctgagcaaggtgaagcttggaaatgattggtgaggatggtgtggaggcagggagagagtggggctggagtgattagtaaggccttgaaagatagacaccactgtattttccaagttatttacagaatgtttccatgtattctatacttcttaaatatcatctcaaccctgtatggttgatgtccctacatatacacttatgtgtttcctgtagacttagtactcttagggttgtgacacaatttaacttaagttaacaaggatatttattggcttaggtaactaaagaacaacccagggattccagagcttcaggcatgactggatccaggggctccaaggatgtcatcaggactctatctctttccattcttcggcttttcttgtgttaacttcatttacaggcatgctgtcaccaagtggtagcaaagctagtggtcaaagacagtagctgtaaactgccatccttaatggattgagagcatttttccccagttccagccaaaatcccagggctggttctcatgggctcagtttggattaaatggtcattgctgacccaatcaatcactgaacccagggagaaggaatatatcaactggccatgtgggggtcacctgcctcataccaggaacgagagggtgcgatcagccctgtccaaaccatgtggattgagagtggggagttttggtttctcagaagaaaactgaggtggtattcccagaagatgggggaaaggaggctgggagggtactactcagctgtgggagaccacgtgctttgggaaactttgggtaaagtgtgctgagatgttgaataggaggagggcacggtaaatgactgtggatgagttgcaggaaaatgtagatttttagccactgagcttgggggtctccatctatgatccactgtcaaaaaagatccttcgtgaaccccctcaataggagatgggaaccactgagggatttcagggaacaggccagaactgtattctagaaaatccttttggtagacaataaggagggcagatggtaaggaggctgggcagtgtggttcagaggagaaagcggggtttggataatgcagaaagacattccttggctgggccccgtggctcatgccagcattttgagaggctgaggtgggtggatcacaaggtcaggagtttgagaccagcctggccaacatagtgaaaccctgtctctactaaaaatacaaaaattagctgggtgtggtggcacgtgcctatagtcccagctactccggaggctgaggcaggaggatcgtttgaacctgggaggcggaggttgcagggagccgagatggtgccactgcactccagcctgggcgacagagagagactccatcttaaaaaaaaaaaaaaaaaaaaaaaaaggtgttccttcatgagcctgggcctgtaagggtggggtgaagcgattctaaggggtctgtgggaaatgtggtctggccatggcaggctcagctggcacgatgtcatctgggtatccaggactcagtgagcagccttaccaccgccctacccctttctgtaaggctgggaagctagaatttcttctttggtcaggaaaagtgggctgggctttgctttgagaaacactgctatctggtgttgcctttttgcaatgtcagcctgtggttatatttcctttgttgttgctaaggcaagatttgctcactcattgttcagtggcacatcacttcctgagttgctgtgtgccaggccctgtgcttggtgatgggatacagcagggaacatgacaaatgaggaccctattgttgtggagctgacactctaatggaggaggcagacactacgagaataaccacagatgtactgagtttgtgatcctgggcctatgcgaggggtgatgatggttccctcttgtgtgcgtgctgccagtgagacgggtagaacacgtgcagggtggtgcctgcctaattttccgcaaaatctctcacctgcctggcaggcagggcaggagatcgtggtggactttggggataccccttggtccagctgtccagccagtgcctgaatctggtctgcagtcttcctgccaggttttttagccacattgtgaacactttcagtgacacaaaactcattcttctagcagcttcttctactgtagataatcctttctctcctgggaaaccgcaggagccatcatgcttctgccctcacccccacccagagagatgggcagtcatccttttgaaacctttggtatcaccacgtcacatctctgctcagaactcggcaatggcttttcgtcatgcctagaataaaatctgaactccttacaacagtcctcaaggccctatatgctatctttgtcccctccctctctgatgtcacctcctaccacttttcctctggcttattttcctgcagcgacactggcctcctcactgtccctctgatatcctacctttaccctgcctcagcgactttgcactgcctgttttgtgcctggaatacagttcccttcctacacagttcccttcatcactttcttgggggctctgttcagatgtccttgtcttggaggacttccttgactcctgcctaaaatagtttcttgttacaccacccttggcactctttctttttttccctgcctctctctcaaccctggccactcttgacctgctgttttttctcaaagcacagatcactagttgaaattacatggttgcatgttattgtttattgtctgtttcccccactgaatgtcagctccttgagggcagggctgtacctgttttggtcatctgtgttcccagcacccagcccagtgctctgcacacagtaggtcctaaattgttgttgaacgaatgcataaagaccattgaactgggcatttacagtatggccagtgctttgcattcgccattgcaacaaacccgagactgtggttcaaatccaggtttgtctgactctacatccttggctcaacttagggattctgcctcttaagccccagtggcctcatctctgagctgggtttgacaatagtgcaaacacattaggagttggggacctggcaagtgacagatggtacccccagaagggtataatagaaaacaagggctctattcacagaggtgggggcagcagtacaggacaggaggaaatggtgttattggagcctgtgagagtaggatctgcagccaagggcccccttccccaaaatgggggacaataaacaccttgggtgcactctcctcctgccctctgctcctctcatccccgctggtgttccccactggttcaactctactggcagccagggagaggctgggagatgcacaggcttgctgggggttgagtatggagagggagtacagagtttcaggagactgttgtgaggattaaatgaagtcatgtatgggacttgcttggtttagcatccaaagcacaatgaacggggttattagatggatgatgaaagcacttgatcagtcttaggttgccacactgggtgtctcccctccctcctccttcttgccctccctctttctgtttcctttcttctcttgtttaccttcctttctttctttttccttccttccctctgagcttttcaactctgctaagatgggcagattgaaggattgtttgctccaagaaaaaaattttaaacctctgagatttatgcaaagaatatgtgacttcctgaccttccagaggcactgctgcttgtctttggcacaataacgccattccttcatcaaggatgcacatgattttttccctcttcacattttcacgttgctgaattaggacatgtctcatagctgggagggcttttcctgaagacagacctcatctttcttgttaaacgctgtgtctccagcacccaagacagttctgggctcgctgcagatgcttggtaaatatttggggtatgagtgaattaattctgacagtggtggccgccttgcatgtgcagcaaatgtgtgtgtgtgccgctgacaaaacttgctggcacatccgtagaaagtctctcgctggggaagtgcccagattccgtttctgctagactgcctttccctgtctgatttgctctggtcctgatctgggagtgtggacttggaatgaagaagtgtcggtcccagcggggacatcattagaaataccacctgtggtagacatgtgaagcacctcaaggatgggggaacccagcacgttccttttgtgatgatgaaatatttccgacatacaccaccaatgtagagagataatacaacaaaccctcgggaaaagctaagaaacaaaccttgacaattgccactgcagtgtctgtttccctcctgtagtcacctgctgtcccactctccccagagattgtcacaatgctgaatttgacatttaaaattcccatgcatatatgggggtatgtgtgtgtttatgtacataaacatacactgtacattcttttttttttttttgaaacagaatctcgatccgtcgcccaggctggaatgcagtggcacagtcttggctcactgcaacctctacctcccaggctcaagtgatccttctgcctcactttccctagtagctgggactacaggcgtgcaccaccatacctggctagtctttgtatttttcttttttggtagagatgggatttcaccatgttgcccaggctggtctgaaactcctgggctcaagcgatcctcctgccttggcctcccaaagtgctgggattacaggtgtgagtaatagcgcctggctacaggactttcttgtgattcacagtagttatgttctgtaaagttgccacaaagactgaattaaccaatactgaattaaccaatggcccctaggggaaatatgtacacacatatctcacttagtttatactttagatcctaaaaacaactcatcctggtcaattccattttcttcattttaccaaagagtgttaggaagtgttaagagactcgcccgaggctgcctccctaacagttgctggagttgggattcaaaccccatccaactggcccagggctggagcttcttgcactacatagacctgtccctactgtctctgtcctctggtaacatctgtatgaagctggaacaagaagacagagtggggccctgtttaacttcagcttggaacctgcacattgagttactcaaatttttcactaatcttcgcttgtctgtgagtaactataaatgtgctgcaagtattgattttagggttaaaaataatttcagcaaataagcaaagtagcaaatacagaatctgtaaatcatgaggactggctgcatatatatgtatttactatgcctgtatgaatgcctaaatactttatagtaccgttttgcagttttaaaaaactatataggccaggcgcagtggctcacgcctgtaatcccagcactttgggaggccgaggtgggcagatcacttgaggtgaggagtttgagatcagtctggctagcatggagaaacgctttctctgctaaaaatacaaaaaattagccaggcatggtggtgggtgcctgtaatcccagcttctcaggaggctgaggcaggagaatcgcttgaacctgggaggcagaggtagcagtgagccgagatcacaccactgcacttcagcctgggcaacagagctagacaccgtctcaaacaaacaaacaaacaaacaaacaagactgtatataaaaagcatcacattagacatgtgaatccttttgcaagtaatttatttccccttcaggttactgacagtgtagctgtggctcattttcactgatgtagaggaatagttagtgcttattaaacacctgctatgtgctgggagcaaatgctttatatttcatatttggttgaacccttaaggccaccctatcagttagatactattcttattcccatttgacaaaagaagaaattgaagcatcagttgccctaagtgcttaggaaatgtttattgaaggaatgagtgatggagacgacctaagtgatcatcaataagatgattggataaaggtggaattctaagtttaggtgaacatatgaagagttgtcatagggaaactttcaaggaaggcatagactgaggtttgcaagagttctagcacttggtgtggtgttttgggggttcagattgtggggaaggtggagaagacctggatgctggctagctaaaccccacagaggtctcccttgcagacaccaccttctcttccagcagtctcctgcactgtggcacagtggagtggctgcagtcgctgtgtgaaacctgccaggtctcctaccatgtacaccggaggcgtgtcctgcaggagccgaggaatgggggtgtccccttcccgctgctggaagagcgggctggctgtgtggagtactggagccaccagggagtggagtgccagcagtcattgcatgagtggggatgggccccaggggtggctctcagtgggaacagtcaggctggactgcagggccctccatgagttcttgggtagggtctgagtttggaatggggctttgccttcctttgccctgatcccccttctcatcttgtgaatgagttcagaagctctgaactccactgggcttctcagtcttctttctgctcctctccctgtgtgaatcagtcaggactttgtatgcaggtgataggagacccaacttaacctgaactgagcaaaactgtgtggctcctgtaactaaaattccaggggctgcattcaggcatggctggatccaggagctcaagcaatgttgccaggaatctctctccatgtctcagctctgttttcctctcagttggcctcattctcaggcaggcttttccctgtaatggtctttgacagcttcaggcttccctctaaccagcctaacagctgaagagaaggcctctttccccatagttccagcaaatatcctaggatatttgtggtggtgcgcacacccgaagtcccagctgctcgggaagctgacgcaggaggatcacttgagcccagaagtttgaggttgtagtgaactgattgcactacaagaccctgtctctagagatcaatcaatcagtcaatcaatcaaaaggtcgttctgactgttatgtggacagcagactgagaggggtcagagggaatcagggagcctagggaagaggtggctgcaatggttcaggcaagagactatggtggttgaaccagggaggtggcagtggggtgatgaaaagtgggagtgttgcttcctctgcttgaaatccttctccctacccccagccactcccatccagccattcctgggtcatcacttcctgtaaagatgtcagtttccctgaggaagatcgggaagatcatcctgacttgctaatatgtgccaagtgcctcaccacatgacctgactctgtgaggtcagtgttactattctcttcttacagacagggaaaccgaggctcaaggaggtgacaaagcttgtccaagtcacatggctattgactagaggaccaggaccctcccattctgacctttgatatcacccacctacaatcttttcgttgtactgttttttgttgttgttgttgttgtttgttttttgttttttttttttaagacaaggttttgctcttgttgcccaggctggagtgcaatggtgcaatctcagctcactgcagcctcctcctcccgggtccaagccattctcctgcctcagcctcccgagtagctgggattacaggcacccgccaccatgcctggctaattttttgtattttttgttgagacgaggtttcaccatgttggccaggctgatcccgagctcctgacctcaggtggtccacctgcctcggcctccccaagtgctgtcagaatgtagtaaggtgatatatgatgagcacctactacataagtgctcaataaacagcagctgaattattttctttgctcaccgttacagccatgaggctctgatctttatgactgatcccttgaatcttctttcaaaacatctcacctctgtatttgagggcttgtcccttcaccatagcatgagagcaacagctgcatcacagtagctaacaatgtcaagcaaattacaaagggaagaaacactcactgagtacctgccttgtgccagaccctcgaccaatgttacattacattctgacaataacaccaggatgtagatactgatattatccccattttgcagttaagaagaatgaggctcagacaggtgcagtaacttgatcaaggtcactcagctataacaaggggagttgggactaacctgggcttagctggggctctccttactgctctaggtgacaccaaaagtacaactacagctgttggaagagggaagggaggctgtgtgttagggattcctaaggaatcacgaacctcttgtgaaatgattatcaattctcttctatgttctcctctgtttgatctagaaaggaagaaacttggaagctggccaagtaaaataattttattcattcatttgtctttctatcaatccatccccctatacctcctttcttccatccttccattgttacattcactcattcatctattctcccatccatccatccatccatccatccatccatctactcgttcatctagccatttccactcatctctctgcattcttctatcttcttccattctaccttcttccattcttctatcttcccatccatccatccatccatccatccatccatccatccagctatccatccatctatctacccatccattttttattcattcacctatccatccacttgtcaactctccatccatcctttccattcatcctctcttccacccatccatctttctactcatctctctgtctctccttttcttccagcctctcatcttcccatttatctacctattatacatccattcttcctttcttccatcatttcagctatctatccatttattcatttagtcattgactttaaacattttattttcttcttttaaaattatttaattaattttttgcctttcctatggtgctgatagttattgactcttttttctttgttttttttttttgtttgtttgtttttctgttttttttttgttttgtttttttgagtctaggtcttgctgtattgcccaaggctggaggacagtgatgcaatcatggctccctgcagccttgatcttctgagctcaggtgatcctccccttttagcttcccaggtagctgagactacaggtgcacgccatcacatctggctaatttttgcaggatgaggtttcaccatgttgcctaggctggtctcaaatttttgggctctagcaatcctcctccctcggcctcccaaaatggtgggattacaggcatgagacattgctcctggctgactaactcttttatctactctattaaaaaaatcattcacttattcattcagcaaatcattcattcaaaaagaatttttgagaccacaccaggccctgaagtctcagagataactatgatcctgcttccagcactataaagggcactggtagggattatctacccagttcaaagatcctacagtctctttagggctgtcttgtaagtgacttggataccagaggtaccaagctcggtgtccctatggtgccatagcctgggatgtggtccgccctaactctgttttctccttgacccacagtccctgctttgataaccacaggcagctacgggaaagagtgggaaaagtgagatagtcccaagaaacaggcaacagcagggtaagtgaaaatcaatcaacctaaagtcaaactaaaatttgtgaacatgtttccttgaactaagtttcttttttttctttttctttttttttttctggagatggagtcttgctctgttgcccaggctggagctcagtggtgtgatctcagctcactgcaacatccgccacccgggttcaagccattcttgtgcctcagcctcctgagtagctgggattacaggcacacaccaccacgccaggctaatttttgtatttttagtagagacggggtttcatcatgttggccagactgatctcgaactcctgacctcaggtgatctgcctgcctcagcctcccaaattgctgggattacaggcgtgagccaccgtgcccggcccaaaatttcatttatcacgtctttctcttactttggcaacatccatatctccccgtttgtcaccttgttacacctgcaagctcattaacatggattttaaagtccccaatgattggtctccattcaacttcattcattcacccattcattcaactttgattgagtgcctactatgtgacaggtactgtgctagtccttgggttatggcaaggaacaaaaaagacagaaatacttggtcctcattgagtggacagtctagtgggaggagagagacaaaaaacaaataacatgttggagcctaagtgccatggagaagataaagcagggaagggggtaggggtgccctgagaaggtgacatttgaactaagatctggaggaggagatctgggggaagagtgtgcctggaagagggaaacagcaagtgcaaaagttctggggcagggcatgcctagtgtgttcaaggatcagcaagaaggcgggtatagtttgagtgcagggagagagtaggaaatgaggttgaaaagataacaaggtaggaggtagatcctgtggggcctgtaggctgtgttgaggagttgcgcactttctctcatgaggtgggagtcatggtagggtttttagcagaggagtgacatgatctgacttaagtcttcacaggattccttgggatcctacttggacaatggatagaggagaagcaagggggtaactcgggagaccaatgaggaggcaattgcagtggtccaggcgagggaagaaggtggtttggaccagggtggtttcgtcgtaccttgtgaaggatggattgtggggactggcgacagatcagcgtgttgtgggatcgcggagctgaggtcaaatttccaggacagtgcctggctcatgataggtactcagtaaatatcagttgaaagaataaggtctgaactaagtcagtggcaatggagatggacaggagaactaaaagggttaggattcttttgattgcaagtgacagaaacttagctcagactgcgtcaagtgaaaaggtgaagtattggtttagataaccgggagggaagttctgaaataacattacttcaagcagggctggcgccaacggtgtgtgtaaggccgtcagggctggctctcgtcccctctctttctgtcactcgctccatgggttgactttattctcaagcaggctctttccctgtggtggtcaagatgggcatcttgcagagattgtggggataagcagccccacatcctcccagatcagtaaccccaaaagtgtcctcttggaagtctcagcggatcatatctggaggagaccccgattgggtctgcttggatcctgggcccatccctgaaccagtcgtcgtggccaggaagatggggaactctggtcggtcaactccaatcacatacccgccttagtggcagctgtgggagccacggccaggccggctgagtgatggcccctccaagaccatagggcgagggcaagaagtttccaaacaaactgccaaaaggggaagagaaattgtatggggaagacgcaatttctagttatcacagacttctggtaggggacagattcccgaggggatatgggggcagatcagagagggaaggactggggatgggctttcggctgcacctggaagaaaaccgtgggctcctctggccaccagggggcagcagattcacacagagtcattcacgagtccttgacacgccgcgtctcctccagcagggggtgctatttactgctccttgtagaaaaagttgggtggaagtaaaatttggcaaattctgggtcttatttcagatacccttgaatgggggggctttccttttaaagaattctcattgcaaatctttttttcttctgttttttgagaccgagtctcactctgttgaccaggctggagtgcagtggcgccatctcagctcactgcaacctctgcctccggggttcaagccgttctcctgtctcagcctaccaagtagctgggactacaggcgcgagccaccacgcctggctaatttttgtatttttagtagagacagggtttcatcaagttggccactgcagtgagccaccgcgcctggccttttttttttttttttccctctttttttttgaggcaaatctttttcttttctcttctttttctttctttctttttttttttttttgtggcaaatctttttaataaaataggatcttttgaaagaacgtgccgggcgcggtggctcacgcctgtaattccagcactttgggaggctgaggtgggtggatcacctgaggtcaggagttcaagaccagcctgactaacatggagaaaccccgtctctactaaaaatacaaaattagccaggcgtggtggcacatgcctgtaaatccagctactcgggaagctgaggcaggagaatcacttgagtcagggaggtggagtttgttgcggtgaaccgagattgtgccattgcactccagcccgggcaacaccagcaaaactccgtctcaaacaaacaaacaaacaaacaaagaaaagaaaaaacacagtggagagcttaagagtatctatttaggcttattttcagcagagatggttccattttacatcccactgcttattaggtatgtggccttgggcgagttttctctctgatcctccgtttcctaatctgtaaactaggggaaacacctaccttgcaggggttccatattccatcggccccaatgacttatttaacattttaaaaactgagctggatataattctaggagttggacccaacagtaaacaaaacaaatgaacattcctggcattatggagccagccttctaatggggaaaacagatgagaaataaaacactcagtcttttggataaagtgcttagaatagggtctgcctggtacatggtaaaccctgaataatgttaacttgaaaagcagaagttgaatcttgttgtatgcaacctgttgaggccaattgggttgcacaaaagattcctgtatcagggagaaattgtaccaacctgggcctaagatagggctggatgtacagtaggtgcttcataaatgctcatgggtacttgaggtggtatctccctgtgtggctgcaggtactgtgtccagttccagttggggtccattccagggagctgcgggcaggcgagggcaccccatgcccagtggacaaggtatctgagtcagggccacacggtctgtgtgaggagtgaatggcctgcccaggacaccaggagccggcgctgctacggggacggtggtggggccaaagggtgagcgacaggactcgggcatgggcaggtgtggctgtagagcccagggcatctctgctgcctgagatagcaccctgggagagagatgctgctccctggccagggcgggggccagcagggtcccaatcccagggtccaaagagaccagccagttaggagccggactcctgccacttccggtggtgtaaacttgggcaaatctcatcacctctcggatcactaagtgcctcatctgaagatacagataatgagaggacttccccatcggtcaggggtgagggctaagtgagattgtgcaaggtgaggacctaggacagtttctgacatccagaaagtatccaagaaaagggagcttgcatggtcattgaaccctcacgagtcccttaaaggccagatttggttactctcattttatagatgggcaaaccaactcagagaggcagtgtgacttagtcaaggtcacacagcagggtttgacccagatttggcttacattatccctctagactgcctcccgtggggtgagggtatcttggaaagcacttcacacatactaattataatactggcttacatcgattgagcgcttcctatgagttgaggattattccaagctctttatattccttcattcattcagtgttgagcatgtgctaggtactgttctgggcactagggattctgcagtgaagaaaacagctgaggtcccttcccttatgcagacagtaaggtcccttcccttatgctgggaggaggcagacatcgggcaaataaatctataatttgtcagatgggagatgaatgttaggagagaaagcagagtaaggatgatgtcctgggggttgttaattttttttttcttttctgggtcttgccctgttgcccaggctgaagtgcagtggtgtaatcccagctcactgcagcctcaacctcctgggctcaggtgatcctctcacctcagcctcccgagtagctgggactacaggatgcaccaccatgcttggctaacttttgtattttttgtagagacggggtttcaccatgttacctaggctggtcttgaacaccttggctcaagcgatctgcccgcctcagcctcccaaagtgctgggattatgggtgtgagccaccgtgcccagccattatttttaaaagcctgatcaaggagggtaacagaaaggaggtgatatttggacggacacccaaaggaaatgagggaggagccatgtggatctctggaggaatagctttccaggcagagggacggcgagtgcaaaggccctgaggtagagcgtgcctgctgcactgaggagcaagagaggccattgggcaggagcagagtgagtgagggagagcgtagaaggaggtgaagtcacactaacacaccgtatgccaatgaaacattgcaagaatctaacatggatacttttaggatctctgctttccagatgagttgactgagatacaaagaggtgcccaaggtcacatacctagcaaatggcagaaatgagatttgaccctgaactgctcagacccccaagccaagctctaaactctagtctagactgtttcttactgaacatgcttttccggtgcagggattatcacactgttggaatatgagctctctctggggtctgtacagggagttctaccatttccaagggtgttaatttccttcttttaaaaattaagcagccctgatcactgtaaacttagaacagggaatgccaaggccagttagggtgttagggagaaacgcatttaggcaggaggcattggattacacagatctgggttcagattccacctctggccctgattggctatgtgactctgggcaaggcctgcacgtgacccggacagtcaccaccacgtacgattgtggggagcacccacaattttgcacagcacctgaccccttgtagatacccactagtgggggctgctgtcattatctctaatctgcagaatagatataataagacgtagtttgtgaaaatgagatgtaatggatgtgatgaacctggcacatagtaggttcccagtaaatacacgtccaacaatattatcacactatagggtggcccttcctgccagcctcccttccaacctccctcccgcttacttgtcctagacctgagattccactgttagagtttcattctttgggataggcgctcactttttagagcttcagtttattcatcaatttttggaaacactttctagtcttaagactctgattaatcccaaatttctctttttggacacaaatactctgggatgtgaaacatggcactttggcaaggctgagatgtgggtcccaggggccacagtacccaccaggaatgggaagggacagaaaggagagccagggctgtgtccgagacaggcatctctccacactccccacctggggccaggctggcagagcaggtgacggaaggtctcatgggggcatgagctcaccaggaaggactggcggagcagggggatccaagagaggagaggcatgagccgtcagccgaattctttccacgggcagctgtgagagcgggcgtgccaagggcatgggcctggagagggattagcctatcagttgggaatttttggagggtttatttagcttaagaagtatccctgagtttgggtcaagcataaggaacatctgccatgagccactcacctactgcgtgctgggcacgcaccaagcaggtgcttcacacgtgtgttcacagttaggccttaggggcacttttagacaagggacatgaactccattttatataatgatgatggcaataataatagtaactttaaaatgttatcatttgtaaaacacttattatctgccacgtactgggcttacaggcttacaacggtgcctggtaccacgtgggaggcgcttaatcagtgtttttttttttttttttctatttttttgatgggggtcttgctctgtcgcccaggctggagtgcagtggcacgatctcgactcactgcaacctccacctcctgggttcaagccatcctcctgcctcagcctcccaagtagctgggactacagtgcatgccaccatgccgggctaatttttgtatttttgtagcaacatggttctgccatgttgcccaggctggtctggaattcctgggctcaagcgatctgcctgccttggcttaaagtgtggggattacaggtgtgagccactgcaccaggcccagtgtttgtcattattgatattattttgcatttttacaaaagatttggattacacctacagaaaattggctttaaaatatatgaacaggttcacaaacatttgggaaggtcacacacctaggtagacactgcccaggcaaggaacagagcctggccagcccccgagacctgcacacgccccctccctcagtccctccctccccataaaggaggcctctgccctgacttctctggtgatccattgtgcgacatccttgccagctttaggaactcgatgtggagccctcaacactatagttccatttcatttcgttttgttttgtttctttccaactttgcatcagtgaaaccacgcaggatgtgctctttggaattcgactgcctttgttccacatgaggtttccaacgttcatccacgtggttgcacttgcagcattagctggttcattcttgttgctgaaatagttagctattactattattattttgagacagagtctggctctgtcgcccaggttggagtgcagtggcacggattcagttcactgcaacctccacctcccagattcaagagattcttatgcctcagcctcctgagtaactgggattacaggcaagtgccactatgcccagctaatttttgtatttttagtagaggtgaggtttcactatgttggccaggatggtcttgaactcctgacctcaagcaatctatctgcctcagcctcccaaagtgctgggattacaggcatgagccaccacgcccagtcagttagctattattatgatcatttttattttctttgcacacagcatctcagatgacctccccaccaacacctcagaggggcaaagattattgatatctccatcttccactgaggagagagaggctcctaggagccaggtcccaaacgccacctgattccagagcctgtgctcttagccactccgtggtgtggcccctcaacagaggaggaaaagggggcacagagcagttaagcaacttgcccagccttgcccagcagggacgtgatcgagccacctccccagaccctcagaactgactctggaatgcccttgtggcctctgagggtcgctggctctgtggccatccccagggtgacttacaagggcccagtgcccatacacttttagggcccacaaagacattttaattttaatttcttttaaaaccagaagaaaaaaactgatgctataataataataataataataataataataataataataatattagtggatcacaaatccagcctggattttacttgtctttatacagtgcagtcacaagctagagggagggtccctgaaagcaaacatccctggagcccaggaaagccatcattcgactgagccagccccatctcttgcaggaacaagatgtggctgtggcaagcggccagccatccccggtgccgagggacctgggagaagctagggcagctccggcattgttcctgccctgtggtccacagcctcgtcttcatctagcgtctgcaccccctaaccgtctttccaaagcctcggggatggcagggaaactgcagggcttgggatcccgcagaaccaaagagttgggagaaatctgcaattttgagactgaaggaacaagccttgtcgttatgttgacactgaaaatagctttatgcttccactcagtgccagctgagtcacggtcctactgacatctcctgcccattcagggcttcccacatttcatctcccagacacactctcctggcccttgccctattctccttattgtatacttaattttttaatgaactctctcccttcccttccctttccttccctctctctctctctttctttcttttctcttttttggatggagtttcactcttgtcacccaggttggagtacagtggggtgatcttagctcactgcaacttccacctcccagggttcaagcgattctcctgcctcagcctcctgagtagctgggattacaggcgtgcaccaccatgcctggctaatttttgtatttttagtagagatggggtttcaccatttgaccaggctggtcttgaactcctgacctcaggtgatgtgcctaactcgacctcccaaagtgctgggattaccggcatgagccaccgtgcgcagcccctccttccctcccttgtctccctcccccacttccctctcccccccttctctctcccccttcccccccttccctctccccctcccccctccctccctccctccctcccttcctcccttccttccttccttccttccttccttccttccttccttccttccctctttcttgacagaatctccctctgtcacccaggctggagtgcagtggcacaatctctgcttgctacaacctcggcctcccaggttcaagcgattctgtcacttcagcctccctagtagctgggactacaggtgcacaccaccatgcccagctaatttttgtatttttagtagaaatggagtttcaccatgttggctaggctggtctcgaactcctgacctcaagtgatccacccatctcggcctcccaaagtactgggatgacaggtgtgagtcaccatgcccagccttcttttctttactcaaataaatttatttgaaaagaaaactacttaaatatatgtttaaagaggaaacattttatcacaattataaaataaaataaacaataatagcaaacatttattaagcacccgtaagagtgccaagcactgtctcagccttttatacatactcactcattggattctgagttagatgcaatgattatccccattttacatgtgagaaaactgaggttcagagaggtttggccactttgctggaagttgcagttagtgagtggcagagtggggattcgaactcaggagctgcacctactgcttaggttccctgcacagtatatcagcctcatgagggcaggggttttggtttctgtgtccctgggcctaaaatagtgcctgacacacaataatgctcaataaatacttgttgataaaaacaaatgaataaatgaatgatcagttgctatactaagaagacaatcaggctgggcatggtggctcacgcctatgatcccagcactttgggaggccgaggcgggtggatcacctgaggtcaggagtttgagaccagcctggctaacatggtgaaactccatctctactaaaaatacaaaaatgagccaggcatggtcgtgggcacctgtaatctcagctacttgggaggctgaggcagagaattgcttgaaacccgggagatggagttgcagtgagccgagatggcaccaccactgcgctccagcctgggtgacagcatgagactctgtctcaaaaaaaaaaaaaaaaaaaaaaaagacaatcagaaaaataaatacaatggaaaccagagaagtccactgttgcctgctcaagatgctgagcatgaagcctgttctcctgattcagacaagaaaccagccagtgtggagtgataggaagaacacactcatagccaatggagacttgctccttgacaaattagaaaaattatactggaatcttggcactttgggaggcctaggtgggaggattgcttaagcccaggagtttgagaccagcctgggcaaaatggcaaaaccccatctctaaaaaaaaaaaaaaagatacaaaaattagctgggtgtggtagtgggtgcctgtagtctcagctactcagggggttgaggtgggaggatcacctgagcctgcgaggcagaggttgcagtgagccgagatcgggccactgcactccagcctgagcaacagagggaaaccctgtctcaaaataaattaaaaaaaaaaaaaaggcttaaaaggaggctaatttttttcctttaggagtcagttgttataaacatttttaacagtgaattcacataccatgccattcacccatttaaagtgtacagttcaattcttttcagtatatagaaaaaattgtacaaccatcaccacagtccaatttagagcatttttatcctcctctgaaagaaaccctgtactcgttagcagcctctccttcctccgacccctctagccctcagcaatcactaatctttttctgtctttatggatttgcctattccggacatttcatataaatggaatcacacaatatgtggtctttcgtgactagctgctttcacttggcagaatgttttcaaggttctcccatcttgtagcctggatcagtactggagtcagttatttaatgctacatcctgggttcgggtaaaacgacctaaaatgtgagtcccccgcttcaggaagcgccgctgtaatgaataaagaaccttttgggggaatcatagctcaatctcttcctggttctaagcgggcaggttcaggcttccctgcggtggggttggagcaggaggtttatctttcagctgtccttgggactgggcaggaacttgttcaaatgttactgctactctatcctccttcctaaatcaggactctggacgctcctgggaatcactgtctgttgctgctctctgggagtgtgaatgaatcactgggtgagaatgtcagtagcacctgtgtgtgctggtctggggcgagaatcctgggccaaggggcagcggaggggagaaagaagcagatggccacgaggccagcaaggggctgtccgactcgtaccccacagccagcattccctgcctctacccgtacacttgttttggctgcaggaagctgttttaggtggaaatcatttgatgtgtgtaggtgctgtcttcccaaacacaccgtgctcgacaattgccccagctctgcaggatagactttttgtagctcttggtagctacccattttttcagcctctaaatagtggtggtgcctgttttaatcctctcatggatcgtgtaaagtaggtgatcttttccccattcacagatgggaaactgagcttcaggatagtcacatgacttgtccaagttctcatgattaggaaacgttggagctgggctttgaactggactgcaaagcttgtgctcttgacgaaataggaaggcagaggctgtggtggggagcagcttggttatgggtacccagaaggcagagccgtttcttgcgtaccataaaatgggacatttaccttgggtactccctttggagtgtgttgctggaacttgtgcagggacttagggaatcttctggggaagaggccagcaatgtgttggggatggagacgaggagcactcagtgttatgttttggagccttgtcctacacctgaggacctccaagtctatcagtcaaggccctttgggaaatgagtgaaagaactcaaccagctcgagcaaggataatttattgactcatgtaaagaaaatatccaggataagactgccttcaggtatggctggatccaggggtttaaaggttgaagccactgcctcactttcttttggccttgctctcctctctgttgactttgtgcttaggtaggcatcctgtggtggcactaatggctgccagcagctctaggctttcttcctccccattctgcatcacaaagctgaagacagcatctcacttccaatggtctcagtctcagctacaggtctggggttgctgcttattgaccaggctcatctcacacccctggttcatattcctgaatcaatgggtggggggagggtgggggaatgcactgttttgattggccggtgctgggtcaggtgcatatccttggaagtggaggcatggtcagtcctacttgaaccacgtgaaccaagaaggaaaactcgggacccttgtatcagaagcaatgggaatggatgctgggaatgtttcaggccacagacatcctcctcgtgggtggcagagaagccaccattcatctctgtggctttgctgccaacttgccatgggaccttgagcaagccacttcccttctctgagcctcagtttcctcatctgaacagcgatgatctttaagggcccatacagccctgaacttttgaggccaacagggtttgtctagccaacagcctggcatcctagcttgacaggtccaagctaaggcttaggaatgcatggccttcagaaaccctggggtcgaacctggggctgggcgcctggcctcttgttcttgcccatcctggcagggtacagcctgtgatgtgggagggaagggttctgaggaggtttctttgcacatccccagcattctccgtctataattggctccaaatgaaatgatctcatccctgaacactgaggaagaaagggtgggggtgaagctgctcgctggcagcatctgacatagtttatgactaacccgcttccctcccgaggcagggagagacggtccgctctctcgaagacaatgtacaattttgaaaaaaaaaataaaaaagtcttggtaaatagattgaggaggctccagcctcctgggcttttgggaggcccaaggcatttttcccctctgcccaaaccaggtatcttttgcccattgctcacaagtcaacgtgacccgtgctattaccattccccaaacttttcacgtcaaaccctggccgggaaggtggtcaatgtagccagtccatcaagcgatttgtcccatatggattctcaattgagttttgtggccggctggagcttgtttaaatgcccatacattaattttgaaagatgagctcctaatcaacttttaaaaagcttgtcacagcaccatctgtttggcgtttgtcactattgcattacataagaggaaagacatttttaaagaatgcggctacatttagtaattggatcgccggagagaagccaaaccggggcggatggcaccgtgattcagaaatgccacgggcccttctccggggtgtggcggcctccccaaattccacgcggtcttggcagagacctgagtgcagcccagcttgggagacaggcttggggtggcttcttttcctcttgccttggtcttcctcttattttttccatttgttctccctcaccccttgctaccccagtattagcagtgaccaagtggctttacttccctgagtcccaatttcctcatctggaaaatgggattcacaagagcaccatcttgtgaggtttaaatgcattaatgcctacggtgcctggcacgtggtgagtgctttataaagtgttgctattttataaagctatgtctgatgcatagtaggtgccaacacatgttcattttccttcctttttcccttccctttatttatttatttatttagagacagggtcttgctctgttgcctaggctggagcacagtggtgcaatctcagctcactgcggccttcacctcccaggttcaagcaattctcccacttcagctccctgagtagctggaactacaggcatgcaccaccacacctgactaattttttgtattttttttggtagagacggggtttcaccatgttggccaggctggtctggaactcctgacctcaagtgatccatcagccttggcttcccaaagtgctgggattacaggcgtgggccaccgtgcccggccccttccttccatttaattcaacaagttcttaggaagtgcccacgtttgaggcagagctggcatcatgcacatgcacagccatttgcacagggccccacactcacaagaatgctgagcttggtttagcgttctgctgtcgctggcttgacattcttaatttttgaacaaggggccctgcattttcattttgtactggaccccacaaattatgcagctggtctcatctggaggtctagaatgatgctatgtcttatttgaccgtctgatatttaaaataacaatagagtcaacgttttaaaatcaggagagttcacacaacagtctggcttattttagaaaattagaacatcttgccactgtgagtctgcattcccacacactgccacatgggctggagctggagtcctctatacaggccacatccgccactgtccccaccactcctggaggctttggactgagtctctttgctcatttatagagcttccagcatggtagctgggatcatgggctttgcagccaggtatgtgttcagcttttctgttaatcatcacagtaacctctctcttagggtagtaaggattaaactagttaatataggcaaagcatctggaatatgttgcactgttattgctactgttctgctttatcctggtgcagaagctcagacccccagtctgagggctgcccctccgggagctggaagctgcgcctgtggcagctggctatgaaagcgtctctttctgctgtcccacacagcagccgttgtcaatgtccactttctctccctccacctgcagcaccagagttcacaccttgggcccgccctcctagcattattttgagaaaagggccttctgtcctgtaaataggctgagtcatccctgcctcagggcctttgcacacgctgcacttgcttcctagaatacttcttttcccatcgctttgcttggccatcttctccttttggtctagctcaaatggtacttcctcagggaggcttttcctgatcgcctaagaaaagtagccctgttttctttcccctgtcatacacattcgcctatattattttcttcccagaactggtttgttgtgtatctcccagaggaccaggtctgccttggtcactgtgatatccctagcacttaggccattgcctggcacatggtagatgtttgataattatttattgaatgaatgaaggaaggaagaaaagaattcatcaactcctcatgaccaccctgtaaagcagggacaagagacctgagtcatggagaagagaagggactcctcaaggtcgcacagcccagaaggggcagaaagggtgatgaggacctaggttttctgcttctacaccccctgtcccctcaaccccccaggtgggaagcagcagagacatttggatctttggctcgaccagccaccaagaacgggtcaagtgtgcagcaaggcccagagcacagcgtctgagggtggtgagagcgattcacccaggcagccaggaggcgagactgtttacaggggctagcggctgtcgccatgacaaccggacagcctacagcttcctgcgtcaccagggacgcaggtttgctcttggctgggaagcagtggggacaatggagtgggggctgggaaatggggggaccctaaacactcagtcttggggggaggcagttctcatttctggttttttttttttttttgagatggagtctcgctctgtcgcccaagctggagtgcagtggtgcgatctcgactcactgcaacctctgcctcccgggttcaagtgattctcctgcctcagcctcctgagtagctgggattacaggcgtgtgctaccatgcccggctaatttttgtagttgtagtagagatggggtttcaccatgttgcccaggctggtctggaactcttgacctcaagtgatctgactaactcagcctcccaaagtgctgggattacaggtattagccaccatgcccggctgggagttctcatttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgaggattaaatgagataatagtctcacggcacttacaatgcaccttgcattgtgccttaattcttgacatcaatctacatctgactctaggttgtcttcttgctggggtagtgggaaatttggtctcaatcatcctcagggatccctacttccctggcttttgtcattcattcaacaaatacttattgagcacctactgcatgccacgtattgttctagaggctgagaccacagcagtgaacaaagcaaacaaaaatccctggcagagtagagctaacattctagtagggatagatagacattaaatatgacaaaaaggaaaatagatattatatcagatgacaataagaagaaaaagaaagcagggctggaggattccaactgcaggggagctgttgcaattttagaaaaattgatgcatggggatgtgagtgtgtcagggaaggcctcactgagagagtaacctttgagtacaacttgaagaaggtaaaagagggagtcacaggttatttgcaagagcattccaggcagagggaacagtaagcgcaaaggccctgaggcaggagcatgagcatgtatgtgactgtatcatgtagtcatatctcttggcaagtctgtgtgtgtgatgttatgtggcacacattggtggcatataggtggttatgcctgtccacatgggtggcaatgcacatacatgtttgttcatgtacagagctgctgtgttcagtcacagaggctgtgcctgaacaattcagggagtgacattcacactgattgccatgaaatgggaccccctggtgtagtgcagcgcagtggccccgagcatatatataaggaaatcaatgtaaaatgtctgtgaaaatgttcacacgtgtatgtgtccggatatttaaatataacgatatgcaaatatgtatatatgaatgtctttaagatgttgatatttcattcctcatggacttttgcttcagtattgatttttaaaaaatattgcattaagatattatttctcttgattactcagtttttgggtgcatcttacatttgcatcagaggcaagtgcctcactctcttaatgctggtcctcgccctgccttggagttgggcaatgaatgtgcgggaggcagggatgaggcaagggaagcctctccttctggctccttccagcatctgggctcatcagcacatgactagaatccaaacctaatctgaacacattttgttcctttaaaacaagatttattgagtgctgactgtgcgccagggactctgcatacattattttattttatccttaccaccatctctgggggtagatatttgctcattccattgaacagacatttgcttagggcctactatgtgccaagagtataagctggcatttgtgctggtctggcagccactcctgatttttctggtaaaagcaccccagttttcctttagggaacctagcctcttccctttactgtccaagtggtttcacctgggctttctgtacccctccctcagactccaggggtgggggtgtgatccaggcgacccaatcagcatactccatcccttttgctccagagattagttataggacgagtatctaacccaagttggttcaatcagagtgaatcctgggatttttgctgccctgttgggaaaaagagctctcttttcatcaggatttctagctgtgagaattctgtaaccctggaattcccagtgagagtctactacatggagagagagagagagaggaaaaactcatcccttatgacatctttaaagcccctggatccagccacacctgaagtcagttaccctaagatttttcaattctgtgagtttatacttgtttttctttttaaaagccagtttgagagggaagctgaaatcctgtgcttggcatctttgtacattatctcctttaattcagagatgaatcccatggggaaggggctctgattgtacaagaactgatcctcagggagggaggtgacttatccaaggtcacagcaggttggtagttggagcttgaattcaagcccaggtctctactcctgagccgttctgccattccacatggtctgacctctggacaagagggtttgtgtgagtattagtgacatagacccgagtcctgttatggccactgttttgctctgtgaccttgatcaagtcatttctctaatatgagcctcagtttcccatctggaaaaatggtagtgcttaccccatcatgctgtcgtgagatgatccatgaaagtaaagtactcagaacagggctagacatgcagcaatgaacataaactattattaccatggctctctttttttttttttagaaaatttttttttaaatttcataggtttttggggagtaggtggtatttggttacatctttagtggtgatttgtgaaatgttggtgcacccatcacccgagtggtatacacttcaccagagcagtatacactgaacccaatttatagctttccatccctcacccacttcccaccttgccccgcaagttcccaaagttcattgtatcattcttatgcctttgcatcctcatagcttagctcccacttatgagtgagaacataatgttggttttccattcctaccatggctccctctttgagggaagaaaggggacccagggggctccccggccaccctgctcccatcctccctgatggccacaggctcccagcagcccttgatggcaccttcatccatcttctgccagacacacagaactggctcgcttacccgggaagcaggcacttaaggaggcgcttccccgctttctcttttaattttcgttacataaatttcacatttcctggaatagagagcttgaatgtctggactcatttggaaatcgagtcagcaaagggcctcatttatattaatggggactcgagcctgacttgagacgtggcagagacaaggatggatggcagcagctcctaggcccagccatccaggctgagctcagacactgccttgagaagcagatgcctccagatttaggctgggactgttctcgttgtgtggggagctcctggatgcaagggcggtgttgtcacccctcccccactgaaacttcccaatggctgctcactctctcagagggaactccagtctgcttatcctgcttgacaaggggctgcgtgatggacccctgctaacctccctgctcctgcccaccactctcctccctcatccttcttcagtctggctggcctcctgagagcattcctgcctcagggcctttgcacttgccgtgctctctgcctgaaaggttgttctcctagctcatcccgtggctagctccttccatggcttgtctcacagacagcacctcagggaggccttccttgattgcccatctggagaaacactctccagttactctgtatcacacccatttcattttctccatcacactgagcaatagtttgtattttcttgtttacttatttgcctatttatttattggctgtctttcccatgagagtataaaccccattagagcacagactacgtgtctccttcagctttgtccccctaggatctggctcagagagacagatttcttaagcaccttaataaatatttgtggaatgaatgcctgcactcattcagcaaaccctttctgagtgccttcctggtgccaggctctattctgggtgctgggaacacagctaagaaaaagacaagaggcagggcacggtggctcacgcctgtaatcgcagcaatttgggaggccaaggcgggtggatcacttgaggtcaggagtttgagaccagcctggccaacatggtgaaaccctgtctctactaaggatggaaaaattagccaggtgtggtggcatgtgcctgtaatcccagctactgaggaggctgaggcacaagaattgcttgaacctgggaggtgaaggttacagtgagccgagatcgtgccactgcactccagcctaggcaacacagtgagactctgtctcaattaaaaaaaaaacaaaaacaagacaagattgttggctgcatggaactcgtggtctggcgcagagaggaaaacaccatagtaacgaacatttattgagtgtgacaaggattttacaaagagacatcacatttaatcctaactacagcccttggaactattatttgtaccagttcatgaggcacagagaggtgaaatagcttgctcaaggccatacagttagaaaacagaggagccaagattgtggccaggccatccggctccccactctgctggtttaacaagctcactgaagccactgggagttaaagccttgtgctgtgaaacctgtgatgggggaggctctgaaggctgtgggagcccagaaaaagcacctgacctattaggctggtgcaaaagtaattgtggttcttgccattgaaagtgatggcaagaactgcaattgcttttcacaacctaatagcttttgataggagaaaagatgagcaaagcctcctgaaagatgcagtaccttagttgtgtctagaatgtatttatttttaactttacattatagcttaagaacttttaatatctccatgctgtccacagttaaaattttaagtaatgcatattattccagtgagaggcagcaccatccatcactgttggggagtttcatgcttgcaattttgaggttctctttaatgctttgaggaccaacaccctggacttactggagtaatgtagcgctcaggtttcggctcctccctttacttggctctgaggattctacatgcctggaacaaggcacatctccaaagtcactaacgtggctagataatggataactagaagtgcctgccccctccaccatccttgtcttgatgccaggtgagatccaggctcctctgccccaagaagggctgagcttacattatctccagctcagcaggtccttggaaattaggttgttttaaggaaataaagaaatgtgatatttcaacaagacactaggaacagcggttgcctctgcagagggaaactgggtggccaaaggatggggtaagagggaaattttcgggccaggcgctgtggctcacacctgtaatcccagcactttgggaggctgaggcgagtggatcccttgaactgagtccaggaattcgagaccagcctggacaacatggccaaaccctgtctctacaaaaaagcccttcaaaattagctgggtctggtggtgcatgcctgtagtcccagctacctaggaggctgagcttggaggatcacctaagcctgagaatttgaggctccaatgagctgtagttgcaccactgcactccagcctgggtgacagagaccctgtctcaaagaaaaaaaaaaaaaggagattttctttgcagatccttttatatctttcccattgggcaccacgtgaaattattaccgagtttaaaaaaaacttttttttaaaaaatgtagaagttaatgtattatttctgcatatcggtctgtggactaagctttatacgatgcattcattctctttatttacctcaaatgtgggaagtagctattattgcctcttcctgacaacaacaaaaaaagcctgaggactggagatgggctgtgccttgcccaaggtcacatggtgaattagtgccagaactgagactccactgggtgcagtggcccacgcctataatctcagtactttgagaggctgaggcaggtagatcgcttgagcccaggagtttgagaccagcctgggcaacatggtgagaccctgtttctactaaaataaaaaatacaacagttagctaggcatggtggtgtgcaatgtagtcccagctacttgggaagctgaggcaggagaatcacatgaacctgggtgatggaggttgcagtgagccgagatcgagccactgcactccagcctgggtgacacagcgagactctatcacaaacaaacaaacaaacaaacaaagaattgagactctactccaggccttctaacctgtccagggggtctccacttctccaggtacctcttcctttactggcggaagccatgccgaggtgtggacagaggggtggtgatacctctgtagttatcacctacagtagggtggtcacacgtcacactggtgttacacaatctgggctcaaatcctggggctgtccctggcctgctgcatgaccttaggtaaatcacaaaacctcttgggccttggctctgtgatagctgggctccaagatggctccaatgactctcaccttccagcgctcactcttttgtgtggccctctttggcagtgaatagggctgacctgtgggaccaacagggtattttggaagtgacagtgtgtgtgacttccacagctagataataaaggatattctaacaatggaatattattcagctcctgggctcaagctatcctcccacctcagccttccaagtagctgggactccgggcgtgtaccaccatgcctgtctagttttatttttatttttgtagagacagggtctcactatgttgcccaggttggtctcaaactcctggcctcaagtgatcctcctgcctcagcctcccaaagtgctgggattacaggcatgagccactgtgcctggcgccggctgatgtctgtcttgactgcaacttcacaagagagtctgtacaggaaccgtccagctaagccactctcaaatacctgagccacagaaactgtgtgaaatgtaagtgacgattgttgttttaagctgctaagtgttgggataatttgttacacagcaataggtaatgaatacagtttttcatctgtaaactaaatattgtggtaatttcacagtgtcattgatgataataatttcatgatgactcctttgatgatgacttcataggttgtatttcatacggttgttgctaagaaattagcaaatgctaattagtgcttggagcagtgtctggcacccagtagattctgagtaaatgttaactggtttgattatatgttctttgttatttctggcactgtgagatgctgagcctgaacaatagattccccgccccccttttttttctgagacagagtcttgctcttgtcacccaggctggagtgcaatggcacaaactcggctcactgcaacctccgcctcccgggttcaagtgattctcctgcctcagcctcccaagtagctgggattacatgcatgtgccaccatgcctggctaatttttgtattattagtagagacgggtttcaccatgttggccagtctggtctcgaactcctgacctcaggtgatccacccacctcggcctcccaaagtgctgggattacaggtgtgagccacagcacctggcatagatacccattaaggaacatagctaggccccaggctgcagtgggataatagagatggttaggatgagagctaccgctattgaacactcactcaatgcctgttcataagcacttcatatccttccatcgaagcctcagcagcagccctttgaggtagatgctattatttccccatttgacagactagaaaatcaaggtgcagagagagacaatgactggccctaaatcacacaccgaagaagtggggtagccaggatctgaactcagatgtttcagaccccaaagtttctattctgaaccactaggctgagctgcagcttggctccccatcccccacgcccacccctgacacaaagcttatcttttccctttaccaatttcctgcttattagtacagagttaattgcccacacatctgagtgcaatcattagttcattcacctcctatctgcagaatgtcaaactcctttgcactcgggagactggagagtagattcctttagaagtttgttcttgtgattcacgttccctctcccaggctatccccttcaatagctaggattgggaataagaatgcacacatgtacagaaaagcacagaaacatctgccctgccttagttccctacagggtctcatcagaggtggtttcattagccccaaccctttgcagcctggcaccttcagacatgccaccagctggctctcctaatatttgctgtggggccatgtgatcatcaggagggataggtcctcaaacaggcgatgagctcaggacatgggcattgccacacctgttcctctccccaaggaggggggaaagctgtgcagtcacagacaacgtggccttttataagcttgaatgtgatgtgcatacttgtgcatgggcaggagagcagacagggaccaagccaaggctgacagggatcagagggaaggacaggggtgtttgcgggtgcctgcaatgtggcagtggctgagctgggcctgtgtgcctgtacaccattgtgtttcagatatttttgactgtcaagttgcaggaagaagtatattttgcagcatgacctgtaacacacacacatgcacacacaattgacatgaaagtttcatgaatctgtacttaccttttatgagcaatgcatgctgactttgattcgattctagtttattctactccagtctattttattctttcattacaaaattgctagtcatgacccatgaaatatgtcaaaacccccaaatgcaggagttcataatctgggtctacaaacttgtatagaacaaaacgatataattttattttcactgacctctagttgaaatacagcacttcctttaggtatgaatataggcaacaaatcatagtaatatgtttcatagtaattatgtttcacacacacaaaaatcacaggctgggagtggtggcatgcacctgcagtcccagctactcaggaggctgaggtgggaggatcgtttgagcccaggagttcaaggctgcagtgaactatgatcacgccattgcacttcagctggagcgacagagtaagatcttgtctctagaagaaaaatcacagattgttttgtatctcgttatgtttgttgcagatgtctcaaaataacatttatgatcttcactacctcaaaattgtggtcgttactaattgctggaactttttatttatttgagacagggtctcgctgtgtcatccaggctggagttcagtggctcagtcatagctcattggagccttgaattcctggcctcaagtgatcctcctgcctcagcctcccaaagtgctaggattacaggtgtgagcaccaggcctggcccgatcttgttatttaatttgttaataaagaagcacttgtattactacatcacacatctaaaatattttgaaaattgcatttcagtaggtttcctttgtaaacctatgtatttggctaagtgcagtggctcacacccataatcccagcacttgggaggccgaggcaggaaaattgcttgaggccaggagttcggagagcagcttgggcaacatagtgagaccctgtttctacaaaattgataagagaccccgtcttttaaaaaataactgggtgtggtggcaagcccctgtagtccctgctacctgggaggctgaggtgggaggatcacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtgagagggtccatggcacacagagtttgagagctgctgccccagtgagtcctgatacacagttcatgaaacgctaccccatgctgaaagctcttggggggcagagctccggagtcttgaacctcgagcccagcatggaaatcacatcggtggccaatgtttccatagcacatatggtgccagcctctgtacgaggcccttcacatggattatttcttttaatctttacaccaactcttgtgtgaggggtactattcttagccccatgtctctgtctctttaccctacttcatttttcttcttagcaccagaagtgtcatatatttttatctgtttattggcagcctcccccactgggatgtgtgtctcttgaaggcaggaatttgctttgctgagtgcttcatctccaaaatatcaaaatatgcaagacttaagggggtaccaaaaactcaggaatcatgccatgtcacatatcatgttcacacacacacccacaacctcagaaatcgaaataaggaacattttactgcctttttttttctgggacagggtctcgatctgtcacccatgctgaagtgcagtggtgtgatcatggctcactgcagccttgaactcctaggctcaaaagatcctcttgcctcagcctcccaagtagctgagactacaggcacacgccaccacacctggctaatttttttttttgagacaacagtctcactctttcaccaggctggagtacagtggcgcgatctcagctcactgcaacctctgcctcctgggttcaagcgattctcctgcctcagcctcccgagtagctgggactacaggcgtgcaccactacgtccagctaatttttgtgtttttagtagagatggggtttcaccatgttggtcaggatggccgcaatctcttgacctcgtgatctgcccacctcggcctcccaaagtgctggaattacaggcgtgagacactgcgcccagcctaatttttgtatttcttatagagatgggatttcaccacgttgcccaggctggtcttggcaactcctgggctcaagtgatccccttgctttggcctccaaagtgttgggattataggcatgagccactgtaccctgtctgtaatatttaaaaaaataaaaaataatgccccaaacccataaacaaaatatcaacatttcaagtaaagataggatccaacctcctgcatgtgtacattactgcctggatctccttatcctgttactggtcctgaggggcttaaaacctaacggttgctaaagtgaattagtctcattttgcagatggggacattgaagcaaggatgctaaagaccccctcggtgccaatagccagtaagtggagcagttaggattttgaactcaggcaattgagttccagccccatctttcttaaaccctgcacagccagcctcatgaattatcatgcttgatctttttggtagaggcagtaaactggtaaaatcagataggtttgagttaaaaccccagttttggctgggtgcagtggctcacgcctgtaatcccagcactttgggaggccaaggtgggcagatcacttgaggtcaggagtttgagattagcctggccaacatggcgaaatcccatctctactaaaagtacaaaaattagctgggcatgatggcgcatgcctgtaatcccagctactgaggcaggagaattgcttgaatccgggaggcggagattgcagtgagccgagatcacaccactgcactccagcttgggcaacagagcgggactctgtctcaaaaaaaaaaaaaaaaaaaaattcaattttgccccttcctagctgggtgatcttgggccagtcatctcaatgctctgtacacagattaaagagggcagaggggactggaaggggatcagaatgtggctacttcattaggtgggtccactgtgggtgtgtctgagaaagagtggggagaccgggatgttagagcaggcacccttgggtgagagctgtgggagatgaaatagagaagcatgcaggagccagtggatgtaagtatttgcagaccaagccagggactttggactttatttaacacgtaacagaaagcctttggaaggttttgatggcaaagtgacatgatcagactgacagcttgacaggacccctctggccattatgttgagaagaacctgaaagatcaagggcagaaatagggaagctggtctggacgtggtacaatatgaaggcaataaacaatggtggcctggccccaagctgcagcagtggaggagcaagaaatgcagatcccagatctattttgaaggcagagcccagaggaacggctgacaagccattcatttcagcactgtttgttatagcaaaagttgaaagcaacttgaacgttcaggagtaggagactggcaattaccatgtataatagaacacaacataggcttatgaaagaatgaggaggctcttcgtgtattaatacagaatgatttccaagatacattaaatgaaaaaagcaagatgcagagcagtgtatatggcactcttactatttgtatggggtaaaatcaaagcaaaacaaaacaacacacgcacgctacacatcggttatatgtatgtgtgtgtgtgtgtgtgtgtgtgtgtgtgtgtgtgtgtgtttgcaaaaatgatctctggaaggatacgtgagaaactggcggcctctagggacagggggacaggggtccaggggtataagggaaatttcacttttcattgcatcttttggatttgagattttgtgcctcttctcaactggaggtgatgtcccccaggggacatctagcaatttctggagacatttttggttgttgcaactggggggaggtattactggcatctggtgagtagaggtcagagatgttgctaaacaccctgcagtgcccagggcagaccccacaacagagcaagagctggccctaaatgtcagtagtgctgaatttgagaaggtttgatctattaaaaaacataataaggctgggtgtgttggctcatgcctgtaatcccagcactttgggagagcaaggcgggtggatcacctgaggccgggagtttgagaccagcctggccaacatggtgaaaccccctctctaccaaaaatacaaaaattagccaggtgtggtggcgggtgcttgtaatcccagctacaggaggcaggagaattgcttgaacctgggagacagagattgcagtgagccgagaccgtgccactgcactccagcctgggcgacagagcaaaactcagtctcaagaaagaaagaagaaagaaagaaagagagagagagagcaagagagagagagagagaaagagagagagagagaaagagagaaagaaagaaagaatagaagttttttttttttcaggatggtctttattctgaggttgtatattttatgggtttgatatatcctttgttttactaagataatatatagtacatgatagtcattttttccacatctttacttggcaaaataaaatgtcagcaagccttatacacttctctaagctgaataaaaaattatccgggcatggtggtaggtacttgtagtcccagctacttggaaggctgaggcaaaagggtggcttgtgtccaggatttcgaggctgcagtgagctaagactgcaccactgttccccagcctgggtgtcagagtgagaccacatctctagacaaataagaataaattttttttttttactgggctatgaaatcctaaagtctggaaactacccttttcactcaatgggcttttgaaaggtaatgattttaaaatatgtccacaaaatatttgatcctttttccccaagaggtagaattacctctctctaagtgtgaaccagatttggtgactcactgctaacaaatagaatttggtgcgagtgatggtttctgatttctgagactaggccacaagacgcattgtgcctttctccttacccctctctcttggaccactgcccctgggggatgccagcttccatgctgtgaggatattcaagagccctatggagaagtccacatggtgagcaactgaggcctcctgccaacagccagtaaggaactgaggcctcctcagccaacttagaggcaggtcttccatcccagtcaagcagaggactgcagctggtgtcttgattgcaaccttgtgagagacccctagccagaaccactcagctaaagatgctcctgaattcctgacccacaaaaaccatgagataataaatggttcaacttgctagagtttggggggtaatttgttacacagcagtagataaatacagaaggctgggcacagtggctcatgcctgtaatctctgtactttgagaggctgaggtgggtgtatcacttgaggccaggagttcaagaccagcctggccaacatggcaaaaccctgtctctattaaaaaatacaaaaaattagccaggtgtggtggcacatgcctgtaatcctagctactctggaggctgagtcacgagaattgcttgaactcggcaggtggaggctgcagcgagcagagattgtgccactgcactccatcctgggcaacagagtgagactatgtttcaaaaacaacaacaaaaaacctcccaaaaacaaatatagaaatctttgagccctatcagtaaggcagagatcacagaaaggtagcctatgggctctggtctgcctacagatatatttcctttggccagtacaggactacaaaaaatggaattaatcactaatgtttatttatttttattttttatttattttatcttttagcagagacaggatttcatcatgctggccaggttggtctcgaactccgccttggcctcccaaagtcctgggatttcagttgtgagccacatgcccagccatagttgctaacatttaaaagttgggtatttcctttaaaaatccagatttctgacttctcttagaaagatctaatattgctgggcccacatccctatggggtaacaaccagctggagatgaatggtgttcacccctttagacagggtgtgtgttctgttttttatcacactcaccaccacccccttaagtctcttagttaagttgctttactcatttatgttacctgctctgccccagtagtcatttgagcttatgccttctattgtgagacagtttttaatgagatgcccaggcatagttgacatgagaactaaatgaccagagttggaactttgattcatgaatatcatgtaggatgggttaccactgggttgcatagtgggggtgaaaagccagttatattttcatgtcctccctcttctggggggaagagagaaagctgatgccgcctggagacaggattcctgattcaagtccccttacagcgcttcccatctcgcctccctgtgccctccaaaaaataaactcctccaggcttgttttttccataccttttattgaactctgcagacttcattaagggaccatttgcttagaaattcttaaacatttggacatattttacaagacaagacagcagctggaggtcacacaaagatcacaatttcatctcaccacatgcataaaaagacactgggatttgtgtgtgtgtgtgtgtgtgtgtgtgtgcgtgtgtgttgcgcacatgcgcaatgcttattttcacctttacaggaaggactagagacattaactgacgagagatgaataggacccacgaatgcacccccgagaaaagagtggctgaggacattggtcatttatggctaatgtgattggcttggcccctgtcaagggtgaggtgatcagaatggctttactggcagaaaagccccaacctcacacgacgggttcctgggagagacagggtcttagctgatgggatctgggggcatactatcatgacggctttggggctcagaaaaaaagatcttcggctctaaaagctggagggcaggctggccttaatatccagctggactcccatggctcagggaatgcaatccagtttccagatgttggctcctatgtttctgccccaggaagtcccagaccaaaggaagtcccaacttcgaacccttggcttagtccattggaaaaccacttggtggtcccccccatgggtcgtgtgtgagctaaaatagaacatgaggctgagaaatgcagggtaggggaagaggaaggagggcagagctgctctgtgggcccccaggaagtgtggctctgagagggctgtggcccttatcagcttggggcctacaagcatcaaattgagatgtcatcttgagtcaaagaaagatgaccttgatggggcagttatgggtttcagtgggagaggggctcctcatttttcttctcttcacagttaggtagggattcattaactcccccattcactcacacattcacgcatccagtcatccactcagaggccaaccagtcacacattcactcactcacaaaaacacaggttggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattgggagtttcttatattttcatgaaatatcctatttttgtctccttgtgttgttgcaacttgagtgattctgcagggcagagcctccagtgaggagttgggaggaatcttgaaaactggtttttattttattttggtttcagaggaaggcggctgctcattctacccatccaaacatatcatcctgcccaacctcatactaaaacaaccaaagacaaaccagtcttcggttcaccctgaggttgaagtctcactttctcccaatccaccatacataaaccctctcttgtcaaatgctttccttagagaatgcagtatgcaggatgatttgggatggaggccacagctgcaggagagtggcattctgcttggaggcagccaagagcctggttttgctgtgaaactggattaaaagctgcctttctcttttgacccttctggatttttttcattgacggggactttcaaaggtcttgagtggggtctcttatttgatttaccaaaaaaacaagcccttttggaatggagccatttgctattgcctgggaagttgttcattgtggggatggctagtggggaacagatatcattgcatcttttatacagaaagccccaggctcatgagggcacaggagctgggcggaggggctgaagcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatttctgtggttgttcagcccagtttccatgcaatgctagggcccctctgcaatgcccattttttacaccatctagccagcctctctttaaacacctgtgatataagggagctcactgtccaccatggcattgagctccatggtcagacaacccagcctgttaggagggcttccttaatttgagctgcaattgaccccatccctttcatacaatagaaattttcggagaacttgcatacagccagctggcagctaagtttttttcttcaggtgcactgccccactccaccccatcctggccagcctttaggagatcttttcaggatctttggagggaggaacagagaattaggtttataagtgaagatgagggttccctcgattaacagagccctacccaaattcaagttggcatttggggtagttcaggagaaattctaggttaagataaaatcagggagagtggatggaaatgcaaactatataacctctttcttgatgaaaacagcaacagccataggcaacagtgtttgcttatctgggcatcaaacccaggaaactactggcagacttttttttgttttgtttttttgcttttgtgcagaggaaaaaaaaatcttgtctgttttatttgactctggttcaaaccagactatcagaggttttcggggtgggagaactctgatcagggtcatagtccagaataataaaattcatatttgagttggcttcctcttgggagttatctgatgggatggctcactgccatctgagggtcccagtttggctcaaatttctgattctaggcagagccccaagccctgcagctgacagtgaggtgggtggtataccaaaacctaaacgaatgcaagttggagattatctgggctttcttcatcttcctgcatgagttgacggatggagaatcactttctgctgaagatcctgcctagtgagatgtcctccgcccacccaggactgaaaactgcctctggaattaattatcaggacagtccaaaaactcccccaggcgtggataggtggaagctggaaaactgcccctgtccttgccacacacctcctgctctatggagccaggcagctggcaagggaaggggagatgagctagcagattcggggacatctcttctcagggtttggctgcaagggtgtctggccactgttttttggtgaagctgttagaaatggattgaaatggactgggtgcagtggtggctcacacctgtaatcctagcactgggaggccgaggcaggcagatcacctgaggtcaggagttcaagaccagcctggccaacatggagaaactctgcctctactaaaaatacaaaaattagctgggcgtgatggtgcgctcttgtaatcccagttactcaggaggctgagacatgagaatcacttgaacctgggtggaggaggttgcagtgagccgagattgcgccattgcactgcagcctgggcaacagagcaagactttgtctcaaaataataataacaaaaaaataaataaataaacagatcgaaacaaggaactgataaacaagttggtgagatcggaggcccagcatgttcttgtgaggttcacgagaacctgaaaaacctctgaccttcagctctgattgatgttacaggccgacagggtgctggacatgtgggagcagcccagccaggagggactcacatgtgttctggatctcagaaatgccagtgatgagtttgcttgcatgagatttttggttccaagatctctggggatgagaaaactcagtcccttcagatccctaaaggggtgtgggatataagtgaaaccagcccacatcccatcctgattttgagggccatctgtagctctgcttccctgggtctcattcctgcattcatgccctggattcttaagaacaacgaatgggagaaacacacagaaatgaatgaggaaagtcacagcattgacagagtccaggcctagtgtcaagaaatgcctacacaaggaagtcaaaccccaaagtctttccccaccctcaagaaatcagaatcaaaaggaagaaaacccaaacagcccaagggacaatggtaggaactgcaaaagaccagaaaacatcagctacgataatgaccaacaatgaaactcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccaggactggtttgggttgcctgggctgagtgacatgaaagcatttggatgctgtcctataagcagtgataggtgaggaaacatcagctcggggctggaagctttccattgtcctgccggggtctcaggggagccccttctccctcctgcccactctgcagctacagaaaaagtcctttcccaaagaagcatgtccggaggctttttgccttgctctcttttgattcaaagttacttgaattgaggctgaaaaaaagcctggggtattgttacttgagattagttggtagagaaataagaataggagagagattagcgatagagacctggctttagtggctcttgtccgtggtgaattttaaatatccccttgtccatggaactagacactccagctgggactggagcaagacagaaatatacaatagttacaaatatcaacaatacattacagttttacagaagagaatactgttttgtttttctccttagaaacatggatcttattaggagaaagggcagagacgaggctacagttaccaagacacatggagaagctggaagtcagtttgaaaaagtttgtatcaccagcagttttcaggggcaagctgggtgggttaaaagaaatggcctcctcaggattttgttgtttttccttcttactcttcttccttcttgatccccagtcctttggagaaagggacttcacgggaacaaatgttctctcctccttttttctttccccttgaagtgtgcttaagatagaattcctaaagaaggcactgagaaatctactgcaccaaagtcctgttggtttcttttacccaaagataaaaaggtgaatatactgtctcctccaaagcttccccacctctctcaccgccggtggcagactctcccccgtgtgattgggacacatggctacctggtccctagccctttcagataattgtggaagttggaatgcaagttcagctgggttcttgatgagtttcagtgaatttgccaaactgaccagcatccattcgccgcgtccagcccctagtttgcttgtttgggttgacttgtttctttctgctctcattggttcaggaatgaatgggaaatggaccaccaagttaaagcaggatttgccttcagaccattgctttcctcttctcttctctatcaagacctttctatcgagtgaacttctcagtgaagactcttaagtagatttcccagtgcatgtatattcacgtacataggtacaggttgggtgtatacatattaaaatttggatatgttcttttttagcgggtggatgggctgggaaaacttataatactctctttcgaattgagcacagaataaaagctatactcccccagtacatacacacacaagtaaaagaaaaaaaaacccaatcaaacccaaacaaaatactttctaagcatagtatatgctgaatttcaattattctgtttctataagaactctataggactctggctatgaagcctgaaaaggtaggttcttaatgatacttctgaattcgtccttcaaaagtgactcaataaaatgctactttacggttggacaaaatacacaaggaaggaagggccaggtcctacatgaccacagaaggcagaaagggcctttggttacaaggagagttgcaccaattggttttcgttttttttaaaaaaaaaaaaaaacaaatcattttcaatctgtacagttctcatctgcttcaaccaacaaatgaaatgcctcgattggaagaaggggtggtaagttccttctcaatatatatggctatattgaaacatgttcactttcctgatatgtaaaatagactatattattattattattattttttacagatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagatgatattgagacttaagactaggtgaaccaataccatatctttcttccactgggaagacatatgcctgttactgtattgaggatagacagaactacactattgtacttgggacatcatccatcaacattacattaagagaacaacattgttccattgtactacagacaggcagaccaataacatgtcatctttactgacaggtgagccaacactatagcattgtattcatcagtggttcaacctaatgccactgtactgaggaatggccaacaacaccatgctgttggactaaaagcaggcaggacaatgccaggtcatcaaacgaggacaggaaaaccaacaccaagaaatacaccagaaccactcaggatgcacacaaatacttattgcttttgtctgtactggctgcatcgatggctgcaggaaggagagttgagcttttagtacagacagtgacactgaaaaaccaatagctggttgacaagaaagagaacagagtaaaacacccaatgtccaactgtcactgtgtccttttgagatgtgcatgtctcctgtatacttgacttcatgagaggccccacccaaggggcaagaacccctcctgacccatgagggttaagggaaggtttcagaggggcagggaaggagcccacagactttgatatggcagacagtaataccagcacaatattacccatgctggccagaaatgggcaggtagcaacaatccaactacagtcccaacaattgggctatgggaaatagtgcttattttaaagtgcaagatgttgacactgtccctggcagaacctatttttgaaaaacataaagtgctttttattttaacttttttttttttaacttgaaaaccacagaaaacaaaacagaatttctattatagtaggtactttccttgctgcagcaggaattattcagtctgaactgggcatttcaatgcgtggtatttttttcctttcatttttgcaagtaaaaaaatcatatttttatgctgttcttcagtaacacacagtctctttgaataaactatttcttttgcatatttgacacttgcatatcttttgagtctacactagtgatgtaaagaaagcgtgttcctcctccaaccctaaaacaatgctctgagttcatgctgttggctgggtgcccaccttctgaacccttcccagattgccagggggcaattagaattgagtacaagtggtgcaactcaccctgatggtatctcaaaataaaatctcaggtactatgaaataccgaagtcaatgaagacatttgagtaagggttttgcgctgggatcgtggcttatggcgcagagacttccccatgaccaatcattccctgtagctgtctaacagtggaatccatccaggaggtgatggacaggtgttcctaggggtggctgggcaacattcaataccaaattggtcaacccactctttcaacaccagccgcttgttccagcatccttctctagctgaagccaggaggactgtcaatgttgccctccgaggctgagatggaaagccacgagagaatggggagtatgtggcctcggtcctgtctaaagtggtggtagtggtggctgtgagttccactcatgtcatctcccaaagagggctatagagttgttacaaggaggtgctgtgccctatggcttggccaacttcatgctgatggacctgtcatggctctcaaggtcttagggagccttctctggagtctctcttctctctgagggctttacagggcctttctgttccagagttcatgcagaaaagctctgtggcaggtaagctgaacagctctcctctttggacctcacccaaaagtctctcctccaaggcagggcagttcagatgctctgatctcgtgtgcttccatgggctcctccccctggcaacacacggacgtcaggggagatgtggttctcaagtttgcacttttcctgaccactggggccttttccagtcaatgcttctgtggagtaaatacagttctgccttaagaacttaggggaggtgggtaaaggggagctttcaaagtggtttttctccgatcttgtccccgtgctgaacttcggactggtgctcccagggaggcttttgggggggctggagtccacactgtagagcagctgtccctcatcatctgtgtctgcgtcaatgtactggtggacacccgcctcaaagttgaacgctattgctgtgtgtttctcaggagaccgggggggtgtcttagcacttgctgtggtgtagatggaggactctgggctcagcacagccttgtccaaaagcgtggcacactccagtccagcgacagcagccgcagcactcccccggttcctgagagggtcatggtacatccctagaacggggaggagtggactggggtcaccctccatgaagttgactttaagtgctcggagcttcaaagggttgttagttttcatggaactcttggggctctcgatgaagaaactagagtgctggctggcatcagggctggggttggcctccacaaacctaccaccactggcacccagagctccccgccagcccacttctggggctgtgctgcccccagtcttgctggggagtgatgtcaaagggctgtgggagaatctggtggcctcagggaagtctgtggcacagctaatgaaactatcaatgcttgacatacttcgcatgtcaatgaccccttctgtgcgagtgggcagaggggctacggggctggggatactctccatttcaagttcttcctttggtttgctctgtgctgctgactccttggtattgaggatgggttgggattgggtcttggccatcttattgtacatgtcttccaactgctgaacgttcaggtgctgaggactagaagacgatctggctttttcaggggatccctgttccttggtttcaaaggacttacttgagctggtttcagacagtgtcctctttgtccatttccatttgttaggagacaagtggttatcttgtactttgtctttcttacccatattctccccatttttctcaaccacaatgtccatcatctcaatgctccgggcaaaagcatccttcatgttcatggatacgatgctgccattcctcttggctctctccagagcctctcgccgtttgattgctttctcctgtctcttctgctccttatagaactcagagaagttattgacgatgatggggatgggaagagcaatcaccaggactcctgcaatgcagcagagtcccccaacaattttccccaggagagtcttggggtagatgtctccatacccaacagtagtcatggtgatggtggcccaccagaaagaggctgggatgcttttgaacttggtgtcgtcctcatccttctcagcaaagaagacaaggctggagaagatcataatgcccatggcaaggaagaggatgagcaagcccaactcattgtagctcctccgcaaagtgaagcccagagactggaggccagtggagtggcgtgcaagcttaaggatgcggagaattcgcatgatgcggaagatctggaccacgcggcggacattctggaattgcagcacgctcttgttggattcggtgaggaaaatggtgacatagtatggcagaatggccaacaagtcaatggcattgagtgggcccttgaagaacttccacttcttgggcgaggagaggaacctcagcaggtactccatggtgaaccatgcgatgcacacggcctccacgtgggccagctgggggttgtctgtggactggccgaactcatcgaggctctgtagctcaggcagcgtgttgagggacagggcaatggtggagaggacgatgaacatgatggaaattatggcaaggatctgtgaggagaagagagtgggatttagttatcaaccaccccacaggatgatcatcataatatcctggatctacagggcactcctcaatgttcaagagcattttcacatttcactagtcatttaatgagccaaaaagagaatttgttgtaatccatttattgtctagatgtggaaaccaaggcccagagaaatgaaatgttttaaagctatcagcaagcccagggttcaagcatactttttcagatagtaaccattttataggccctgaaaccctgcattgtctgtcacaacgactcgactctgcagctgtagcataaaaccaaccttggataatacatacatgaatgggcatagctgtgtttcaataaaactttatttacaaaaataggcagtggactgaatttggcctgtgaaccatgatttgctgacttctgatctagaccagtggctcacactggatggggaactaccttcacagagatgatactaatgataataactatccttgattgagtgttcattgtgtgctaggcactttccatgaaatagctcatttcattcttataataaccccgttcagtgctattagctccattgaacagatgcggacacttgggtttccacagctagtaagtggaagagccagcattttaacccaggtctgtgtgacccaagaacatgagctcttaaggctgtgttaaaaatcagatttggctgggtatggtgcctcatgtctgtaatcccagcactttgggagacctaggcaggaggatcgtttgaggccaggagttcgagtctagcctgggcaacatagtgagactctgtctctatagaagaacaaaggggaaaaaaatcagatgaaagctaaccttttgctagaaaaatgcctagacactcaagattttgcaggtaattcctagggaggcacagacattctgggcccatgttaactcctgattggaactatgtgcttttgggggctaaagaccttggcttaactacctttgagtcccctggatcaagaagagagcttggcccagagaaagggctcaatggatatatgttgaaattaatggaatctaggccagtaggccagtctacagactatgcagaaaagcaaacagatgtaatcaattgctctgagggtcttttttttttttttcaaaaatacaaatccaatcacattactcctttgtttaataaatctccagggctcctcatgaaaaaatccaaacccctaaacctgtctattgggtcccctatacctgtcttgcttttgtagattttccctttctcttcctctgcccctgctaagtgggaaggggggggcctggtcaccatggttgtatcatttgatcctgcctgccaatgatcagagcatgaagtttggataaaaaaatccaagttaagccaatccgtacactggggcttagccagcctacctttgagaaatttgagttcaggaacccaggcggtgagtgggttacgggagggtaagtccctgaattaaatgttaagtagaatctaggcttgaatcagcttcatgataagcccaaccctcaagcaactgtctcccaaatgtaggggacagagatgccataaaaacatcagagaaagctgagccttagcctagacatggtggcttacatttgtaatcccaacactttgggaggctaaggtggggggattgcttgagcccaggagttcgagaccagcctgggcaacacagtgagaccccgtctctacaaaaaataaaaaaatctgctgggtgtattggcacatgtctatagtcccagctacttggaaggctgaggcgggagaatctcttgagcccaaggaggttgaggctgtggtgagccatgaccacaccactgcactccagcctgggtgacagagagagaaaccctgtcttgaaagaaaacaaaagaaaagaaaaaggaaaaaaaaaaaagaaacgaaattagccgggcatagtggcggcacctgtattcccagctacttggcaggtgaggcaggagaatggcttgaacccggcaggcagaggttgcagtgagccgagattgcacgactgcgctccagcctgggcgacagagtgagattccatctcaaaaaacaaacaaacaaacaaacaaacaaacgaaagaaaaagacaaagaaagctgaaccttcaagagaagccagagaatgaagggaaggtgcagatgaaggaggagtggggaccgcaggagggtcatagcagggtgccgagggcagcagttaagagctgaggctctggtgtcagcctgtttgaggttcaagcctcagctctgccatttccttacattgagcatgttatttaacctctctaagccccagtttcctcatctagcaaatgggctgataataacagtatctacctcagagaactgctgtgaagatgaaatgtgttagcacaggcaaagtgctaggacagcttccagcagcacacggtgagtgtctaatagatgccagctgtcatcacaggggaaatctcagcccacatcaccccacccactcagatcaccagcctcggggtggcccggtctcggtctttgcctcctgtccttgttctgagactgtctgctgtatcctgtaagtcaacccaattgctacatgggtgagtgtgggaggtttctggccctgcaatgaatccccagtaaggacacttggttgtcaagtccttctcattttgactctgacctctctctctggccactcctgccatcggttctcaaaattcacactcctctagccgcacactatcattggtcaattctgcatgtccgagcttcttgcttgctgtctggtgaactccaatccatcttttcaaatccagcccatgtgaccccttccctttggagttctccctgctttccccaggcagggttgactgctccatccttgggtttcctcaccattttaccataccttggggatacttaccactcatatcccatcacaggtgcgtgcgtgtgtgtgtgtgcatgcgtgtgtgtgtgtgcacgtgagtgagtgtgcttattgctgcccagaattggtgagtactgggaggatggggatgggttctgaggtttatctatgtgcccccagcacctaacccagggtgggacacctgacaggtgctcaccaagtatttgttggccgttgctcaagttcatggagttagaagtagaagggtcagtaccagaattcaggtttttttttttttttttttagagacagtatctttctctgttgcccaagctagagtgcaagggtgtgatcatagcttactgcagcctcaaactcccatgctcaagcaattctcccacctcagcctcccaagtagctaggaatacaggagagcacaaccaagcccaactaatttttaaccttttttgtaacgatgggatctcactttgttgcccaggctggtctcgaactcctgggctcaagctgtcctcctgccttggcctcccaaagcactgggattacaggtgtgagccactgcactggcctgggaaatatttcttggtcatctactctgcgtgaggcactaggccagacattggggatgccacagggggcaagagagtgccagtgccctgatgggccagctctgaagatgaaagggaatgttccaaggtgtggtgcctccccagcctcaggggttccataacttctgatttttttgctatagttaagtctgacacatcctatgtttaaaaaaaaataggtttgagtttcttgatttgcacccattgaaaaaggaagattctgtaatactttataaatgaaatgtttgaggcagggtgcagtagctcaaacctgtaatcccagcactttgggaggctgagacaggtggatcacctgaggtcaggagtgcaagaccagcctggccaatgtggtgaaaccccgtctctactaaaaatacaaaaaaattagccaggtgtggtggcaggcgcctgtaatcccaactactcgggaggctgaggctggaaaattgcttgaacccgggaggtgggggtggcagtgagctgagatcatgccattgcactccagcctgggcaacaagagtgaaactctgtctgaaaaataaaataaagaaaataaaatgtttgatatatacaaaaatagacctaatttatatataatttatgaaccataatcaaatgaacacctagaacccgccacccaaatggagagacagagcaggcagcagtaacactgacacttcctttgtgtctttcccactccagagataacctctgtgtgcagtttttcgtccctttgtttctctgtatgattttcaataagaatatatgggtccctaaattgtcattttgttgcgtttttttttttttttttttttttttttttaagaggtagagtctcactctgtggcccaggctggagtgcagtggtgcaatcacagctcgaatacctaggttcaaacgatcctcctgctttagcctccgaggtaacttggactacaggtgcatgctaccatgcctggctatattttgtagagatggggtctcactatgttgcccaggctggtcttgaactcctggcctcaagcaatcctcccaccagggcccccaaagtgctaggattacaagcgtgagccaccgcacctggactttgctcagttttgacgttatactgtatgtattttgctacttgtatcactctttccttaatggtaaaaacaaaaaatcaaaaaagcccactcaccttctttattttattttagctttattctaagaaatcatatgcaaaattgctgatttttcatgccagggctatatgtattaaatattcaccaaaataaatatgtaattgttggaataacatcttggcagcacactttttggtgctcctgtgttgagctgaggagtgtgggtcctggagttgaaattctagctcttgccattcattggtggaatggccttgggcatccaaatgttcactgcctcagtttccttatttgtaaaatgaggacatactagtggtttttaaggggatgatttttactcctgggggacacttggcaattttggcagaaatttttggtcgttacaactggtgggaggggtgctcctgacatcttgggggtggaggtctgggatgtcactaaatgccctacaatgcacaggacagctcccacggcaaagaatgatctagcctgaaatgccatcagtactgagattgagaaactctgggacatgccaatagtcagcccctcacaattgtggagttggggacacagagtgggtcagagtgggcagccagtgggctttgggctgagccctacaggaagctgctctcgtctggtgacttctggcaggagggcgcctgcacagggaggaatgggttccctgggagtctgttcctttaagagctgggcagtcttattttcccccaaaggctagcaggggaagcctgctttggtttctaacccccagacaactccagggaaggcccacataattgatgttctggcgacagatgcatgaattatgcacccagctattgtacagacctaaagcaggcaccccttttgtacttgagactgtgccctccctctccccttccctcagcccaaggaagcctaggaaacgagcaaagcagggggaggggctccactggactccaaggtggagggtgtgggggagtgcctgctgctcagggttgggttgggagggtcagagcacacctgccatcggtctgtgtgaatgtgcatcacacagcgtatgcggtaatgcagtgtggggggtctcccctgccccacccctcctgaccccacctgcaagaactttttctttcccagactcagtgaggcccttagaatcagggccacacttcctgcctggggaacttcccaacgtgatttaagccctctgtgcctcagtttccctatatgtaagacagggatcattgcaagactgcaatgaaaattcattgaactcaaaatgcccttagctagtggcacaatcactttaaactttaattgtatttatttctccacatttctttacatttatttatagctggttttggacttgagtttgagtcccaaggctattattccccagctgtgtggctttggacaagccactccccctctctgagcctctatttccttttctctgaaatgaagatgaaggtaactgagtactcacctaaaagccacttaatatataatgttattaaattattattcagggccgggtgtggtggctcacgcctgtaatcccagcactttgggaggccgaggtgggcagatcacctgaggagttcgaaaccagcctggccaacatggtgaaacccatctctactaaatatacacaaattagccgggtgtggtggtgggtgcctttaatcccagctacttgggaggctgaggcaggagaatcgcttgaacccgggaggcggaggttgcagtgagccaagattgagccactgcactccagcctgggcgacaagagggaaactctgtctcaaataaataaattattattcaggtaatttatggtcaaccccatccctaacctctgtactggttgcttttggaagccaggagtagctgtgtagaccccagtgactgcctaaggcagcgtgcgtcctctaaacagctcgtggacccagatggactgtgttgatttggtttctgggataagccccaggaatggggaactgactaccacctgggagtcctcccagccccagctcaggcctggacaggcctctgcttttctgggatctgagcccagttgggcttggcagaactccaggaacccggggagcagaggcaggagccagctccagagactgggaggctgtccccaaattccctgtgaagaggttctggatcctggagcctacctgtctgcaccaaatgggagagggggctttggtcctctgggggaagagattggcaggtggggatccccagggtggaattcaggagtgctggagccaggccctcctcatcctaatcgtcggctctggtggttaatcacagagaggcctacggactgtttatcgtggcctctgcacacttccctgctgttccaggaatgtggatgaggcacagactgtccatgcagaaaagggctcaagcttcctgctgggaagatggggaaactcaagcagagaacggaagtgacttgcccacggtcacacagcccattgctgtcaacactgttcagtaacactagaagctttggcaagctggaagctgcacctagtgtttagggcttgcaaattgctcttcgtaaacatgcaggtttatagctgcagtattcataatagccccacagtggaaacaaccccaatgtccgtcaactgatgaatggataaacgaaatgcagctatccatacaatggaatattcttcatccataaaaaggaatgaagtgctgatatatgctacaacacagacgaaccatgaaaacattatgataagtgagagaagtcagacacaaaaagccacttattatatgattccatttatatgaaatgttcagataaagcaaatctatagagacagaaagtaggttagtggttgccagggtgggggatagggattaacagttaatgatcataaaggacgtcgtgttctaaaaactgacttagggcaaagcctgcacgatttggtaaaatttaataaaaattatcaaattgtatgctggaaatgggtgtgcattatatgatacataaagtaagcctcgataaagttatataaaaagttgctttccataaagggcagcccattgctattgcttttcttttcttttttctttctttctttttttttttttttttttttgagacggagtcttgctctgtagccgaggctggagtgcagtatcgcgatcacgactcactgcaacctccgcctcccgggttcaagcgattcttgtgcctcagcctcctgagtagctgggattacaggccaccacgtccagctaatttttatatttttagtagagacagagtttcaccatgttagccagactggtcttgaacccctgacctcatgtcatccacccgccttggcctctcaaagtgttgggattacaggtgtgaaccaccgcaccgggcctttttttttcttttgagacaggatctcactctgttgcccaggctggggtgcagggatgtgatcttggctcaccgcagcctcaacctccctttttgtattttttgtagagatggggttttgccacattgcccatgtcagcccattgctttccatccccacaacatatggatagttcataggagagaagaagctgagcaagccacagagctgctgtaagccctgcagcgactccccattctcccagttaagttccagttcctgtgcctttagttggcatgtgcttattgagcacttcctaagtgctatgctagttgctgagggtgctgcatgaataaggaagaaaatttcctagcctcatggagctagcagggagaggcagaccaaaaaaacccaaaaacgtaaaccaggaaagaggcaaggtgatgtcagatagtgttagatgctgtgagttattgagaaaagcaaaccagggggatcgatgcagaagcactaggggtgtccacgggaggcagagtggtcagggcaggcctctcttaggaggtgtctcgttgctgagacttaaaaataagaagtgtgtgtcattcaaagatgcgaacattctaggcagaaggcacggcacgtatgaaagccttgggtgggaataagcctggtatatcaagcaacccaaagaagctcagcatggctggggctgcatgagcgagagcgggagagcggggtgggcctgatgagacctgatgaagagatctgggttttatattaagatcccttttcttctctctcctgaccatttcccctatttcccattgtaacccacactgaatcctgcagaaaccacttaaagttcccaaactcaccaccatgggtgcttccacctctagatctttgctgttccctctgcctggagtacccttcctcctactccaaacccacttctcctggctggttcctactgcctattcaggcctcagctttggggccacttgccccagcgagccctctctgggcccccggtctgcattaggtacatcagttctctgagctcacacagcccctgcgcatctctgatcacagccctggtgctgctgagctgaaactgttttctcctttctgtcccacactaaagtgtcacctccatgagggcccgaactgggtcggtcttgtccagtgctgtgtcctcagctcctgaaacagtgcttggtacagatgggagctttctatatagctgacaaatgaatgaacaagtgaataaagaaaatggaggctgagagaatgaagtgacttttccagagtctcgcaacttgtaagcggtggttccagacccatggacttgatctcaggtctgtgggtctcccaagacgttttcaaggacgtaggaggaggcggctgctggcccatcaaaccttcggtccttttatggtgcttccgcttcccccagctttaaggggggattacagctggggagttttaattagaagggtcactggtgcagatccgattaaggggattgggagcaggctgatggggttgcccgcatcccctacaggcagggaggggtccctggcagaggattggtaagacattggagtcagaagcctgcagggggcgctcgtgggcacaaagggacaggaatcctgtgcgtgtacaacaaaggatgaaagcagagggctttgccatgagaagaaaacagtcacaaagatggaaagaggatggagggccactgtggagggcgccctagcccttataacccagaggctttgctgctgggaagtttatttttacttggttgaccgagtttcaaaattgggagattttacataaaaatccagattttcacattcttttggaaaattagatgctcgtcttcactcaacctgcattcccagtggcaaccactggctagagctaaggaacagcaaccccttgggagagtgaaccagctccctagtgtgccacaggcccttcacctgttttgtgatctgtctctgcaggcagctgggtttgcagtcactgacccacctgaggcgataatgaagacaacacctgccatagggtatgaagaactttccagacaagatctgcatcagactccacaagccaggaacatgggggtcacacttgctataccctgccctatccccatacccagggatcaggagacaggagcctgcagggggcaggctaagagctaagaaggataagtaggaagtaaccatgcagagtgaagggaaaagcattccaggcgaaaggaacagtgtgggaaaggccccatggcaagaagatagtggttgctaagtctgatcaattcaagttcaccaacatctgcgcatctgttccattctctccacctgcacagtccccaccctcccgcatcaggacttctttctggcctccccaaaaccactctctggcccactattgcaaagaccactagctgtcaccaacatctattcttcccctcttccattgtcacagagttttagctggacccagggctgcccagaataaagactacatttcccagcttcccttgcagttagatgtggccatgtgattaacattggccaatggaaggtgagcagaaataatagaagccctgtctccttttcctccttgctggctggcaggcagatgtgctgggcagagctggagcaactgtcttggatctgagatggaagcgaatctcagtgctagactggccctttatggaaaaagtttgccagctcctggtctatctcatgacatccatcttgttgaagccactcactgtattttggggtctcattgttacagccgcttagtctctccctgcctgactaactctccagccttctcttgttccatgctcttctctgccccctcatctcaggtacattaaccagtaaccttcctttggtcgttcatagtcttcactatcttcttgccacgggacctttcccacactgttccctccacccggagtgcttttcccttcactctgcctggttacttcctactcatccttcttagctcaagatcacctgttcaaggaagccatccttgactttcctgaccaagtcaaatcccaatcacagactctcatagtactattatccttctcctcataacactgttcaagttgcaattttgcagtaatgtccacctctgcagactgtaagcagtgtgagggcaggggttatatctgatttttctcaatcttgaatccttagagcacatagttggtgctcaatacatatctatggaacaaaggatctcatttcatcctgataacaatcctacaggctgtgctgtgcctccacctgttttataattggggaaactgaggcttaagaacaaatgtccagaggaacaattaagaaaatagtagatggccaggcatggtggtgcaggcctgtaatcccagcactttgggaggccgagttgggcagatcacttgaggtcaggagtttgagaccagcctggccaacaaggtgaaaccttgtctttactaaaaatacaaaaattagtcaggtgtgttggcacatgcctgtaatcccagctactcaggaggctgaggcaggagaatcgcttgaacccgggaggcagagtagtgagccgagatcatgccactgtactctagcctgggcaacagagcaaaactctgtcaaaaaaaaaaaaaaaaaaaaaaaaaaagaagaagaagaagaagaagaaagtagtagagagagagtttaaactgatgtatactagactttgatgcccttctttattttaaaaaatatacatacctgggacctttcttatcctagtatcctggggtctggtttttaacttatgccttcacttgaaccgtctctctgaggtaactgcactcttcttaacaagctctgggttgggcaacctcttcctaacaggccagccaggttcccacaagcctctccaaaggcaggaattctgggagatggtgatgtcaccatctcctgccaacctgaggacaatggtctctggtggaggaggaagagggactcaaaactgatccctgcagagggaagaggggatgaagaggcttgtttctgaaggggagaaatgcgagacagtgtgctccctgcctgggtggttgccaattccctatatttgctgaggacatgagcaggtgggggaggaactgtcagtgttaaccgtgatgaatggcacgggtccattcctgttgtagagagcaatgtattgaatgaaaaatgaggagcacaggaagtgttaggcaaggacagtgtccccaggttctgccggccacaaaccggtttccttgtcctctgagtctggctggaggggactggggagggtagtctctgagagcttgaccaaggtggctggggttgctaatggaagctaattatatgagtctggagagatgctggggttaggtagtactctggctaatgtcagaataatggctctgtgagtggtctttttttgacaatagccagatttactggttaatgtccaatctactttttgaaagagacattttggtggcttaacaatagatctttctcatctattatgaaattatagcagtttagtctcaccagagattcatattgaggtgaaatggacacgtgggtagtcaggagacctacttttaattctggctgggcatgcttcggcaagtgtcgtcacatctctgatctttctcatgcaggatccactgagagtctaatgggtctccagtacagttcctttctaggtggtgactcaagaacctagtggctctaccatctcaattggtagcctccagtcttgccaaggcagaggaagggacagtgtgggcaagtcacacttgctcttaaatgcccgcacccaaaagtgatacacatcattccctccctcaacagtgaggcctctggtctcttactgtgtcctccagggggacacagtaagtgctttgaaacttacaaaatgctttataacaggctaaggagatggtccccaatatgggtgtgtgcacaatatgacacactgcagtgcagaaacaaatgactggcatttctaccctttactgttaaaaacaaacaaacaaacaaaccaagaaatcaagttttcctgatgttaagtccatgaattaacatcgggatccttgttcactcagtatgtcaggcagccatggagaaaggagaagacccctggcgggagagtaggggtgcttcagcttagcggggttggcaaggaagccctcacatctttgtttgatggccgcagtgccatgtatgtgtgtctggggtgaagagacttctagcactcatgggtgtctggttccagtcttcttcctgggcaaaatgtctatttcctcgaggcagtggggcggggatatctggttctgtatgggctctgtgtgggtactggcagaggcatttaagagtgggtgtgagttcttcacacaaaactttgatgggtaaagtcaagagattgtggatttcttcattactgtagcacaatctagcatcttctcactaattcatctggtcgagtcaggttacagattctattttctgattttaagctaactagtcctctcagacaaagatgaatggcttacaaagatcctggaaaacgggcatggtggctcacacctatgatcctggcactttgggaagctgaggcgggaggatcacttaaggccaggagtttgagaccagcctggggaacatagtgagaccctccctcccccctgtctctaaagaaataaaaataaaacataaagatcttggtaaagccacaagggtttgggggtagtattagcaatggaaacacaggagaacatcaagacagtggctgaactgatgcttcccccaccccagtggtctgagccctttggcagtgaaaacacaaagttaaaaataatgatgatctcatcagatctgacaagaggttggccagaaaagggttgaaatgatcaggaagactctttgtatgtgaattttcatctactctcttttacagtgagccctattctcattcattcatcaaagaaagaaagaaggcaggataaatgaaatttgataaggaatgaatgagctagatccagggggagggaggcactagaatgtgttggttaagaaccaggacttgcattttaatctgttttcaattttccagctgtgaggcctcggacaagtttcttaacctccctgagcctcaatttcttcatctgtgcaatggggatcaccagagttcctccctcactgggttgtcatgtgggaattcaatgagataatgcgcgggggtgcctggcacgcagtaaggcctcgatgaatgttagatgttcgtttgttttaaagctgcgaggagtacttcgcctcgatataaggacgaccgttctaatggtgggagctgttacaatgagctattgttattatgcaatggagggaggccaaagagaaggatggaatcagcaagatctgggttcaaatcttgcccctgacatttactggctgtttgaatttacacaaggaacttcatctccatgagcttcactttcctcatctataaaaagggactattaataccaacatggtcagattcttataaggatttacctcattcattcattcattcattcatgtggggatgtgccaggtaatcttttaggccctggtaatactgcagtaaacaattcaggcaaaaatcccagtttgcacggagctgatggttttgtagagggaaggggcacacagtgaacaataataagtcaacaggatcatttcaggctatgataatggctatgaaaaaatgaagctggtcaggggaaagagaatgactatgagatggtttactttagctggggtgatcaaggagggcctccttgtggatgtgacatttgagctgagacctgaatgataaagaggagctggccacatgaccatcagtgggaaaagcattccaggcagagggaacagcaagtgcaaaggtcctgaggtaagaacgtgtttggcaagcgtggctgaagtaggttaagtggaggggacagtaaggaatgtggtaaggggggcagatcttagagtgcctccaggccacacacaatgagtgcagaacatgctattattattagtatcattagcagcagtcttcctctgactcccttgtttgtcccccactaaggacctgctttggaaaacaaggacatccattcttgtggttctcctggaagatcccttcagttattcaactgtcccacatgaaaacattcagggcagcaacactccaagtccttggtctggttgttgaaggggaggttgactcactagagtgtaaggaatgattgcattaattgtccaggaaagtgacaaggaggtgactctggtcatgcaattttgagctttggcttcaacctttgggggcctcgccctgccacctcccattctctcaattcttaatgctcaggggtgagatttctatgggcctcgggccactttgaggaaagccatgcgtgcacgagacaagtatccattttctactctttcacagaatcctgattttgtgcttacgtgactactttgcttgaagataacaccgcccagcctcccctgcagctggatggaggtcacatgcttggatctggtcaataagatgggagtcggagtgttgtgtgggacttctagaatctcttttttcttttttgtttttcgtattttttttcttttttttttttttgagaaggagtctcactctatcgcccaagctggagtgtagtggcacgatcttggctcactacaacctctgcctcccaggcttaagcgattctctgcctcagcctccggagtagctgggattacaggtgcgcgccaccatgcctggctaatttttttgtattttagtagagatggggtttcaccatgttgcccagggtggtttctaactcctgagctcaggcgatctgcccgctttggccccccaaagtgttgggattacaggcatgagccactgcacccagccccagaatctctttaaagcagggaaggctgcctcctctttttagatcttcctccatcctgctgccagggatgattacatgattgctggaactctagcagccactgagagtcgtgagactgaaaaccccactctgggaaaagcagagcagaaaggtggaatgaggctggggccatgatgactttatagagccatggtactagtcgtggactattttcatctggactgatgagagaaatatacttctctccctgggtctcactttgttatagagccaggcctagattctaatcagcactgcagtggttagcccagtaattctccagtatatggagaatatggagtacaacttacacatggactgccaacccatctgatagtaacacaggcaaaaagacaccggttgcccagaataacgtagcaatggactgggaacaagttgctcagaaaacaactccattccatggaacttgagtagttccctgtgtccttaactggctccactccacacccttccttccttccctttctggactctcagtagcctctcattttcctgttctaagagggaggtcaacagagacctcggcaccttttcatttgctgttccctgggcctggcctggagagaccttttcctgccacctcccctgccccttcaccagtttgctttcttccttctttcgggactcagtagcaatgtcaccagcttttcctagactgaattaagttgagtcagccctttcattgccctgtcacagcagtctttgtgaagtttcatcactcgccttcttaaagtcctccagtggtgtcctgctgcacttgaaacaaggtccaaactcttatggaggctgcacggccctgcctgacttggcccctgttgacctctctgatctctttttctctgtgctcttgcacatagtcactcccttccagccacactggccacctgtctgctcttccacatgccaagcccactcctgcctcaggacgtttgcacttgctgtttctctgtctagaacatcctcatcccagattgtctgtgactggctccttcttatccctcacagtctctccttagagagactgtccctcactgcctgattaaaaatacctcttcctcagtcactcactcttgctgcactgttttacctccttggtgatttgtcacaatctgcagtcatttttttttttttttgacagggtctcaaaagggtgcagtgatgttatcatggttcactgcatccttgacctcccaggctccagcaatcctcccacctcagcctcctgagtagctgggaccacagatgtgcgccacaatgcccagctatttttttttctttttgtagagataagatctcactatgttacccaggctggtctcaaactcttgggctcaaggaatccttccgcctcagcctcccaaagggacgggattatagatgtgagccaccatgcctggccaaatcattttgtttatttgtttgtttactcatttattttccgcttctccaccaacctaggttagcacatcaagggcagggactgtgtctatttcacaaggctgggtccccactgcccagcacagagccagatgtggcattggcactcaacaaatactggtgcactaaatgactgcctgaatgaatgaacaggtgaatggtttgtgagttggtcagttggatggagggatggatggatggatggaagtttggatggatgggtttagaagccatgaccccaatcggaccacccaaatgcaatatgtttactgagcacccctcctatgcaaggcactattggaaaatgcaagcttgaattagcagctggatgcctgatactaatgatataataacagctgagatttattgatttctcaccaaagcaggcactgcgccaactgcattgcatgaccgatctcatttactccttatatcaaccccaggaggtagatactctcgtaattcctgctttgcaattgtgaaaaccaagcctcaaaaaggtgaggttccattggaggaggaaacatttgggctggggcttgagggctagagatggattccagcaggcagagatgggagtaggggtgttctaggcagaggcagctgcatattcaaagggttggaggtggggaataacagtcaagccagtttggctagggcaggtgtgcacacagagagaaaactggcaagaggggagaccaccatttactgcacacccgcgacatgtgaggtaccaaagcatttattcaccatcaccccaggaagtagctcctcttttcaccttcatttttcagaggatggatctgaggcttggagcccctaaataacatgcccagagccacacagcaggattaggacttgaattcatgcctgtctcactctgaggctgggtcagagatggatagtcagaggttcaggaaggagttgacaaggctggctatggagtaactgagcatgtactgggagccaggcacagcatactatctcaattaatcctcacaagtacccaggaggtaggtattagtgtggtggatatgtttttggatagtttagcatcattttttgggaattgttcctcctccacaatcacgcattaagtgaagttgaccctgtttctccgtttcagggggtaagagtgagatccaagcttaccagttaggataattcatctccctggccacagggattactttagtagtgtgggcatgactaaaattggtcaatcagggttcatcctggaactttttctcaaattattgggaaagaggtggtctctttcatcaggggctgttgggttaacaggatatcaaccagaagtggctggagggtcaactctggctctctggggaaaaaaaatctgcccaagagtgtagccaaagcagagggactctgtgccaagacacaaagacaggtttctaatgacattatttgagcacctggatccagccatccctgaagccatccctttggattttccaacaatatgaactgatgaatgctctttttggattaggccagttgggctggatttctgacccttgcaaataaaaagtgatctgactgaacaaaattgttatcttaattttacaggtgagagagctaagattcatagaggtaaaatgacttgcgtttaggatccacaggaaggaaggggctgaatcacactgagatatcacaaagaaagtgcatggcatctaccaggtcctcaagaaatgcctgttcccttcttccatagatcaaggagtggtggagagaaggacgggaggaggtatacccactggtggaagctcccccatgagccgcaagcttctgggcagattctagattgcatctggaatcctccaaactctcccagcctgcactggggtctggcaggagcaaccaaagcccaggagttgacacataaagtgaacaagcggtcagatgtcagcatttgaacaaaattcctgaggatcccactctctccaaaaaagtgtcatctaagagccctggctgcaacacagggtttccatagaagggccagaagtcttagcacttctcagggcttacgcttagtaggatcttgtacagataattgtttcagtaccaccaaggattctgtggtcacttgaacttctcaaagctccttcatattgaaactggatagagagtaaggggttagcctacaaactttgactttggacaaagttgggttccaatcctggcccttggcagctgggtgactttcggtacattacttaacctctctgagtctcccgtgtgaaacaggcagaatcggaagatgaagtcagacaaaacaggtagacactcttagtacagagtttggaaccacttcagcttttgggcaagcagattagttctagatataggttgaactctggcatgtatgatcacattaactctctgagcctcagcttcctcatctgtaaaatggggctcagaataataccccctgcacaggtggttgtcaggcagcaatgaaatcatgcatggaaaatgcgtaccccagggtacgcatgtgaaccgaggacaccctgccagcaggacggccccccactcatccaccggcagggagttttggcccacacagtgaattcgttgccaatatttattttccctatgaattcacatttgagcttctcaagaaaaatctgaagctctgggtactcttggtccacgctgctccgtggcaagcccaggctgccgctgcgcggtgttaagtccagtcctgtactctaaaatctcacgtgcaccctgtgcgtgttgtttatgaggctcgcttggcttctgcaggaatctggtttgggagcccaggaataaatcattagacgtgtagccagcgatgagggaaaagattaaacagtgccagagaagcagtcatgggttccttagggaatgctgggccaagagctgggtccgcgagatgccctggatcaggaatatgcggatggaatccctgcctgggccagcccctcatccatccgtatatggctgcagagaagccatgttgctgcttccttagagcccctggctgcattttcccctcgtctctcctgcttctagactgctctgaagctcctcctagtccccaccgctcatcctaccacacctcagtaaagcagaattagaggattaaaaaagacgggcaggagataggggactactttagcccaacggctttggagggcctcactgaggaggtgatgcgtgagtgcggatctgaggaatgcaaaggagccagctcgcaaagatctggggaaaggccggtccgggcagcagtcacggcaagtgcaagggtcctggggcagggaagagattggcaagaagaggaggagaaaggcgaccagtgtccctggtgctagggaggaagacaaagggcgtgagagttgaggtcaaagagagaagagaggcaggcctttaagacctgataggatgttttgaacctgagaatcctgggagccacacggccatggcctaatgtaggtttaaagatcccctagctctagccaggcgcagtggctcatgcctgtaatcccagcactttgggaggcggaggtgggcagattacctgaggtcaggaattcgagaccagcctggccaacatggtgaaaccctgtctctactaaaaatacaaaaattagccgggcacgggggtgggcgcctgtaatcccagctactcgggaggctgagacatgaggatcgcttgaacctgggaggcagaggttaaagtgagccgagattgtgccattgcactccaacctgggcaacgtgaaactttgtttcaaaaaatagtaaaataaaataaaataaaataaaataaaataaataaaataaaataaaataatccccgagctgcacctaggaacagcctgtagggggactggaatagaaacaggaatcaaagtgaggaggctgtggtaggtgtccaggcaagagactgtgtctgttcacagtacggaagacaaattcaagttatattttggaggtgaaatcaaccaattgctgatggctcagatgtgtggggcgagggaaagaagagtcaagatggaatcccaggttttcatcctgagcaactgggaggatagtggtggtgtttcctgagatggagaggaatcggaggagcacctggggccagatcatgggggtgctgtgaacatcagctgaggggtctggaccagaccccgcagacaatggggagcttgggaaggcttctgagcaacagcagaatattcattcagtcattcaacaaacatttgtggtaaaagcttgtccatattctattctctcacagacggcaaagctccccacaagcagccgtgggttatgggccacaaacatccttcctgggcctatagagtgcacgagaaagctctacctgcccatccacattttcccttcccgacttcttcacctctggcttgaggagctgaagagcatttaaaaaatattcatggctgggcgcagtggctcatgcctgtaatcccagcactttgggaggccgagataggcagatcgcctgagctcaggagtttgagaccagcctgggcaacatggtaaaaccccgtctctacaaaaaatacaaaaattagccgggtgagttggcgtgcacctgtagtcccagctacttggggggctgaggtgggaggatcgcttgagcctaggaggtcgaggctgcagtgaaccatgtcaccgccacagcactccagtttgagtgacagagcgagaccctatctctaaaaaaaaaaaaattaaaaaaattaaaaaatgaaaatatttatttactccctgcctgtcttttcctctaaaagctccatgaaagcagggaccatctttgtaacttcagcatctctcatgcctagacctgtgtctggtacatagtaggtgcttaataactattgaggaactgaattttaaaaataaataaatgagccctagtctctcagactgaaggactgactgagagcctgtaaagtgccccgttcagggcctggtatacagtagacattcaataaacagtaatgaaaatatacacagaaaatacagccactctgtcaggtccctggtaggtcttgaggcttctccagtgtaggaaaggccagaggagtaggagggtgaggtggcctgtgactcaccctcccggggcccctgtcttgggcctaggcctgtgggcatggcgtctgcactaatccggctaagcagctggatgtgcaagggtgtgtaatcccaggcctgctggctttagcctgaccttggctaggatgacccaagtcaagaagaacgctcctgtcctcttaggccacccagagctgagaccctctacacaaccggggacagggatctaaaagacccttcttgggggacagaggggtggcaggctcacctaggtctccccccgaagctccaacccagctatttggggtatgcatctctgcacccctccccccttgctacatctttgccccagtgtcctccctgatggatgatgcggcacagaaatactatcggggaagaaaaggggcattcattcatcaaacatttatggagccaagctatgtgccaaacacttttccagatcctgaggacacagcagtgatcaagacagactctgtcttcagggaactgatatttgggtgggggaagcagacatgaaatgaggaaataggtaaattaaaaaggatctcttcaaggtgcaagaaaatgggctaatgggatagagactggctgtagggacatcatcaactatggtagtcagggagggcttctctgaggaggtgacatctgagctgagacccaaagatggagtatcgagttgtatgaagatctgggaaaggagcatccaggtggagggaagagattttaatcctagtgagtcatataagttggcaccattgagtacactgaatagataatgaacataataactaacatttactgagtaccgacaatgtgtcaggcccttttctaagtgctttgaatgcaataactcatttaatactcaaaacaatcgatcattttcatccaattttacagatgaagaaaccaagccacagagaggtcaagtgctttgcccaaggccacacagctaacaagtagcagagctgggatttgaacccagggctgctctacctcacaacctatgggttgttccctatctttacagcacattaatgttttacaattaaaaacattaattgttgagcattaccaagcaccaggtcctgggacccatggcgtctttatctggtcctacctctgaaggccacccactgatcctctgccctgcacctctctctcaccctcttctgatgtctctactctgaggccacctccagctccaggagtggccatgtggctctgcctggtccaatcagcatagaccaaccctcccagcctttgtgattgactgagggatgggcatgtgacacaagatggcttcatgagagtggatcttggaactttgcaaccatgggggaggaggagttctctttgtttttttgttttttgtttgtttgtttttttgagacggggtctcactctgtgtgcaggctggagtgcagtggcacaatctcagctcactgcaacctccgcctcctgggttcgagcaattctcctgactcagcctcctgagtagctgggactacaggcatatgccaccacgcccagctaattttttgtatttttagtagagacggggtttcaccatgttagccaggatggtctcgatctcctgaccttgtgatctgcctgccttggcctcccaaagtgctgggattacaggtatgagccatcgtgcccggccaggagttctcttttgagggaaaatgtctagctgggagataggaagcctggagcccaaagagcttgcttgagagtgaagccctcgtagaggagggcagagacaaaagatggagagagactgagttgcaatgacaagcactgatggtattgttcgaggcctgtgtatctgggccagagccagaaccacttctgaacttcgcagttgcatcacccctcccattttttttcaagcttaagccaatttgaattggatttctgtctcttataactgcaatcagaaccttgttttcctcctggaatgttcttccttcttttctctcttgctaccaattaatgttactcttatttattttttatttttagatgcagtcttgttctattgcccaagctagagtgcagtggtacaatcttggttcattgcaacctctgcctcccaggttcaagcaattctcctgcctcagcctcccaagtagctgggattacaggagtgtaccaccatgccaggctaatttttgtatttttagtaaaaggcaaaagatttatacgatctgaagagaaaccagagaataatttttgtatttttagtagagacagggtttcaccatgttggccaggctggtctcgaactcctgacctcaggtgatctgcccgcctcagcctcccaaagtgttaggattacaggaatgagtcaccgcgcctggccccagtaatgttattcttatgaccaccattaatatgaccatcactgccatcgccagtacagcgactattctcatgaatacttctattgccactgccaggaatgacagcatcatcctacttttaacacagtgaacacaggggccattattgctacactgatgctgtttctactactctttctgctattagcatcgcacttcccatttgtaaacctctcctgagtttacaaagcactttcaaaatcctctcattctcttctaaacctcaccacactcccccatgagtggggcacagtcactactgttagttccatcgtaggggcaggggaatcgaggttgcagaagtgagaggaactgcttgcagccatagccaatgggactcagacccacctactcattcatttattgacgaggtggcactgaacgccttcggtatgaggatggactctgctagatgctgggacgcagcagtgaacaacaccgacatcgttcctgccttcgctgagctgccctttgggtgggctccagaacattccaagagcctccctcacaggccccacaggaagccaggccaggatcattctgttctcctcagaattctgagaccagagtggaggagcccagtttgtgagcagaattgaagcactgctgtggattttacttcttacctgagctgccttgggcaacagacccagcctttgagccttccaacaagacagtgaattccttggcaaggagagtcctgacttaatttttctgtctctgctacagtgcctagcacagggtcgggcacagagtaggcactctgtaagtgcttattaatggattgctgctcagaggcagaactaggcctccttccatctacccaactttctattcttctatttgtctaatatctatcaatttccttccttcttctattcatccatccatccacctacccacctatccacctgtccatctgtccatccgtgcattttcctaccttgcttcctccctccttccttctctccccgtccctcccctgttctccttgggcaatgaagaattagtccagcctccaggtttttgctcctgctgtggctactccgaaggctccttccccaggatgttaacattttcctggctcttagcaatttgcaaagagcttgggagactgaacaaacaaacaaaaatccagattctctcaaccacttattttctttttttttttcttttctttttcttttcttttttttttttttttttttttgagacagagtcttgctctgtcatccaggttggagtgcagtagcgtgatcttggcttactgcaacctccacctcctgggctcaagcaattctcctgtctcagccccccatgtagctgggactacaggcatgagccaccatgtccagttactttttgtattttttgtagagatggggtttcgaggctggtctcaaactcctgatctcaagtgatcctcctacctcggcctccctgactgctgagattacaggcatgagccaccgcacccagccttcatccactttttgaggcactccgaattcctactagatttcttatctttcctgacaacccagtagcaatcctatgcttacttttaaaactcttttttctggtttcctgcatagtgtgctctctctcctcccctctactgccagtttgggattgaaaactcaaccaggccagagcagtgactcacccctgtaatcccagcactttgggaggccaaggcaggaggattgcttgagcccaggagtttgagaccagtctggggaacatagtgagatcctgtcactactaaaaattaaaaacgtagccggatgtggtggcacacacctgtggtcccagctactgtagaatataataaattcgtcttcaaaggttttagcctgtaaattgttaagtacaatgagttctgagatcctcttcaaagaaccaatgtatcagtatgttcagctcccctgttctttgttcttcattttaaagtttaactttctcgttctttacgtctccttgcccctagtttcagcaaccaatcttctcctagcctctatcacctgctctgaccttagtcatctttggccacctggtctgttcttagtcatcctgggtcacctgctctgttcttaatcatcccgagtcacctgttctgtaaccatccttcccgccaaactactcaccctgccactccagcttgtacctctgcctctttaaaatagccaatcggaattaccttagactgtgcagtccaaccctagccaataggggaaagacacagcagcaggaactagctgcgttgggatgagaatcccttcccctcccttgtctggtgtgctctccccattgctccatctgcgagatgcacccttctatagaagtacaattgccttgctgagaaaattaaatttatgtttgagtgctgtttcttttgcggcactgaaaacttatttctaatattactcaggaggctgaggtgggaggattgcttgaacccaggagattgaggctgcagtgagctatgattgcatcactgcattccagccttggtgacagaacaagggcctgtctcaaacaaaaagaaaagaaaacctaaccagctactgcagctaggcaggaagtgcaaatgaccaaagcaggctggatatcgaactccaggaaggagtgcatgggccacctctcaagtgggcggccactaccagctccaagagggaatagatgtggcccagagtggtctaattttccagtttctcagtagaaacaaacaagtgaaagtctaggggttcttttggtgaactcttcccaatttgttaatgtgggtaactaattaaaatatgtaaatgcagttcagttcaaacaatacatgcttacaggatagagctgcctctcttctctttacaacccctctggtcactggccccctctttccctccctaccctgcaaattgccacaagagagctcaactccaagaagagcttattgctttgaatacaaacaaaatactgctcataatagctgctacccaaaactgaacatccaagtactcaagtcacctctattgttatcattgttttacaaatgaagaaagcaaaaggctcagagaagttaaggaacttgcctaaggtcacacagctaagtgacaaactgaatttgagcccagggctgtgtgactccaaagacagtgatctagcccagtggtggtggcattttgccacaggaggcattttggaaatgttagggaggacaggtgtttctggttatcatggtgatactggcattcagtgagtgggacccagggataagagacgtcttgcaatgcacagtcctgtgtcgtgaagtcttgtcttgttcccaatgctaatagtaccacggttttccctcttcccccacaatggcagccattattgagtgcctagtgtatgccagggactttagatccagcagtccaataaggtaggtacttttagtatctccattttacagatgggaaaactgcagttcaaagaggggaggtgacttaacaaaggtcacatgaactgggaaatggcagcagggctgagtccagggtgaaaaaaattaagggtgtgaaatttaaggcattgccaaataactcagtaagcaagataaatactactttaatgtaacatttaaaaaatcaaacttaatgtaaaaccccccatgatgaacaaaatatctatattttcaataaagacaggatcagcaacactggtgtgctaagccatatgggagtgaaagggaaaaggaaaaaattaatactgatcttgttttgtttcgtttttttgagacagagtcttgctttgtcgcccaggctggagtgcagtggcactagctcggctcatggcaggcaacctctgcctcccgggttgaagtgattctcctgcctcagcctcccgaatagctgggatcacaggcatgggccactatgcccagctaatttttttttgttttgtctttttagtacagacagggtttcaccgtgttggccaggctgatctctaactcctgacttcaggtgatccgcccgcctcggcctcccagagtgctgggattacaggattacaggcgtgagccactgtgcctggcctgatcttggatttttgtgcccaaggtgagtgcttcgcttaactcactttagtcttgtccctgagtggcaggccatgctaattgtatctgtctctgtctcaccagcctcaataagatgtggggagtccattcttccactcccagtgctccaggacttcagcacgaatggtgaaattacaggctccagaaagccatgatttctaaagcagaagacggacaggcctttaattagagccaggcgggtgggtggccagctaatactaagttccataatactaagttccgtaataagcactgtatttttgaattcactggcttgatcacacacatcccggaggcatctttggaaatttgttcatagaaaatagggtaaacagctatttgtaccctaagagagggaaaatggctttacagtggggtggctatgacaagggtgtgctctggtggcagcagatctgggacaaaccccaccccaccactcactggcagtgtggggctgagcaagtcacggccctctctgagcctctgctttctcatgtgtaatgggaatgagaacacctaccttgctggtgatggggaagattaggattaatggacagtagagtcatatcctcatgggtttggttccaacgataaccagtaagatgaatatctatcacctacttttgaaaatccctacctttatattgtgaggacctgaaaactggaagctcagaagccaggaaatgatgcattttatcccagatgtggcctctctgtttgaggcaggaaggtaaccagctaatgcagagggtagggtgggggtggttagggaaaggccaacaggtgaaggagaaaaataaaagaatttttctttgtctctcttccttctcaagtctcatacattagatgcccaggtgtgaaactctgttctagctaaaattctctggcatatagaagagctcattctggttcaggttttccaaggaacaatcagcaggggttccagaccacacaaatggcctgtttctggctgtaatcacacgtgggagctggctaatgtccccggagtcaggctggagtggccaagacaatcaccgtggatttagccaggggctgctgccttgggaatctttatttgtgcttgtgttgcctcctctgcttccaaggataattaccagggaggtgcacaaattggaggcaaagacaagccactcgtagtgtgcaaaggaccctgatcgtgacagtgcaagtaaacaaaccattaggaatgcaaagattgacagataacaaacaagatccgtgggcaggtgtggtggctcacagctggtaatcccagcactttgggaggccgaggtgggcggattgcctgaggtcaggagttcaagacctgtgtggccaacatggtgaaaccctgtctctactgaaaatacagaaattagctgggtgtggtggtgggtgcctgtaatctcagctacttgggaggctgaggcaggggaattgcttgaaccagggaggtggaggttgcagtgagccgagatcgcaccactgcactccagcctgagtgacagagcgagactctgtctcaaacaaacaaacaaacaaacaaaaaacaagatcttctgagcaggagccactgttagctggaggttggatccagtgattctcagcagggtggcactacccataaggacatgccctgaaaatgtgcgagggtgtcacaaggatgggagaggatgccacaggcatgaagtgagcagaggctgaggacaccaggcgacctgtaatgcacgagacagccctgctcatggataaccttctcttgtcctgctcaatgttggagtgtcccagtggatactcaggtaggtgaacaacaacttgtttaaattaattttagactgtaacttcattttatatataaacccgccaaatatgttttgccaatgttttaatctaccctgaattttccagaaatggcaacgcctggtgaagcaagggaagaactggactttcttctgttcagaactttaccaggagttattcatcgtattggaaaagtcatgcagctgatgtcagtgctgcttgggatatcagagctgccagcacacctgtacctctgtttttgtcacggtcacactcatggtgcttctatgtatagtggaagcatctgacaacctcatggtgttttctggtgttgttgtcctgaccaggcatttgcatactgaaacacacacaagtttaatacaaacgtccttgtaattattcgttctaaagttagggaatgatattgatttttttgaagttacatatatagtatattatctgtgaatttcattttagaatacgaagtggtgggagaagttaacaaaatatttgttatttataaaggggacttgggctctgggagtggaaaactgtgaccctggaaggtgcacgtgtttatacgtctcacccatgcaaggtggccttccttggctgtcttctacctccctgattaggctccaactctctgctcatattttcagagcgtctgcactttttttctttgcggcacttatcagaaccaaagtgcacatgcaccaccctgagagcgagctcctccttcaattttgcatcctgggcacctcactcttccaccctcttctgggtcctgcgaactagcttcagctatttgtagaattagctgtaatgcccatctccccaaccaagctgggcgctccagtgcggggatcgtgcttgctgcatttattgctatatctgccgtgcttagcgcagtgcctggtgtgttttagtcactgattgaatgagtgaagggctgtatatttcatatacatcataggcaaataaaaatgaataaattttaaatttatggcaaggctaaaagatgatcagccctgggtcagcacagagagggtctgcgaaagcaagtaagacctagtcttcctccgtctggcagcggggagagacagatgcaaagctgaggcaagggagacagggaccctcccactgcttgggagaaacacgtctacgttagctgggggcaggtgagggaagacttcctgcaggaaacaccacttgagtcttgtggggagaagagtttgccaagcagccaccgaccacatggtccagctcattattttacagatggggaaactgagactggtggggaaactgagaatggttctaggcccggctctgccaccgtcccgctgtacgaccttggccaagtctttcttcttcagtcttcccatctgtacaatgagatgacctctagggtcagcctcaccttctgggacagaagtctcaaactggcagctcctgggctgaattctcctgctcctggctgttacctgccagagaccaggaggtgtttgagctgagacctgtgtgaaggttaccaactttgtaaattagatgccacctaaaagcggtgattcttgatcaggggcggttttaccccccaggggacatttggcaatgtctggagacatttttgattgtcacactgggtgggggttgtgtgtggggtcgctactggcctctaatgagtatacgccagggatgctgctgaacaatcacaggacggccccacagcagagaactctccagccccaaatgtcaccagtgcggaggctgagaagccccgcctaaaagtccagtccttctgggccactctggctcctgggaaggccccaggaccccgtggtctttgtacttggtgactgatctccagccttcctgccgctgtctggagctgtcctctgactgcaccgtcaccatgctttctccccactaggccctggctccctctagcctccgctttccagggcagggcctgcctctccagctcacattttgactatactgggtcaaacctgatagcaccctggacataggcgcctgtctgttaagactcctgttttccacaattgcagacagatgcacagagagtgtcactagcttgatcaaagtcgcacagcaaagggagtgttggggctgggatttgagcccagataccttgaccccccccgcccccagcccatttactgcaattttttaaatttttttttttatttttttttgagacggagtctcgctctgtcgcccaggctggagggcagtggcgcgatctcggctcactgcaagctccgcctcctgggttcacgccattctcctgcctcagcctctggagtagctgggactacaggcgcccgccaccacgcctggctaattttttgtattttttagtagagacggggtttcaccatgttagccagatggtctcgatctgctgacctcatgatccgcccgccttggcctcccaaagtgctgggattacaggcgtgagccaccacgcccggcctccctgcagttttgtttctgaaaattgacttcctttgggtctgggttttctatgcctcctctcctcaacattcattgccttcctggtttgaactgagccacaaagttacattggaaatggaaacagaaggtgtctttgagaccgtctcccagggtgatgtgctgcggtctcagaaggactctctgacaatgtcacacgagggaggatgggagaatggtatgaatggtgggaactgaggtggcagccacaacacaatggtgggaaaaacaggctccgcactgggttccagcattggagcttcatgctagacccaggacaaattccttcaccgctccaagccttgctttccccatctgcagtgggagacagtgagacttccttaatcgtggaactgtgaatatttaatgggaacgcggatgtggagggctggcccagggcttgttcaatgaggggacctggggtggccactagctcctgggcctgtggaggcaggggatgctctggtggattccagaagatgacagtgggctctcctctctggagggtggacgaaggcaagcgcctctctgactgccttgctttatccttggagaattctccccagtgcccctctgtccactctcatgccacagttatcaccccaagcctttaaccagcagtcccctgggtgctgagtacgtaaccaagaggggagtcctgagccgccattcagcccttctctggcttggacacactccacgttgcatgtccattcggttgcatgtcctgagtgctttctgtgtgccaggcactgtgctgggctctgggagtcactgtccccaagacagcagaggagccaacaaacagatgaaatggcagggagggagttagtgggcgatggagagagtgccaatgggagggaggcagagggttaagaaagcccctctgaggatgcctgctaagcagaggtctgaggccaagcactgtggggaagaggatacagcgtgtgcaaaggccctgagataggaacggtcgtgtttgggcaccagaaaggaggccagtgtggccggtgtggaagaagcaaaggaaagagtggccagagatgataatggagaggcaggcgggtggcagatcgggcagagctttgaaggccggggtgaggaacttgcaatttattttaaggacctagaggaagaggaggctctgggccctgggtggatgagctgccttacttcttggaagcaccagggctcatgggagaacctgaccgtcactcaacccccgaaacctggctggcttgtatgcagcctgtccccgcatcaggaggggccaagcgacacctcgctgcacacagcagcctcattcctgcctccctacctttgctcagacaggatcccctgcctggggtggcctctcctctccctgatttgcccactcttcctcaggaaaccttccctggcagctagagcctatggggccctcctcctcccaaccactctcctggtgttgaaatccactggggtagtttgctgtcaatgaagatcccagggtcttccacagagataatgattcaggtgatctgtgctaggacccaggagttcacatctttacaaacacttccacgtgattcctctgtccggcattggagagacatagctgctggcatgtttccagagctacttcaggcaacagggcacgcagtatgtgtgagggggagaagcagggggctcagtggaatcagaaggccctgggttcacatctcagctttaacacttacccagctgggcgactgtgggctaatcaggcagagctttgaaggccagggtgaggagcttccaccacctcttagagcctcagtttctttctttttttttttttggagacagagtcttgttctgtcacccaagctggagtgcagtggtgtgagcttggctcactgcaacctccacctcctgggttcacaccattctcctgcctcagcctcctgaatagctgggattacaagtgcctgccaccatgcctggctaatttttgtgtttttagtagagatggggtttcactatgttcgccaggctggtctggaactcctgacctcaggtgatccacctgccttggcctgccaaagtgctgggattataggcgtgagccaccgtgcctggctgagtctcagtttcttcatttataaggtggggacagtcacactgacctcagagtattgtgaaagggatgacaaatataatgtgcctaacccaagaggttgcccacagttggtgcttaatagatgcagcctggggcccactccacacttgcttccctaagggcctgaataaggcaatgctctctaaaccagggctcagcaaactttgtctgtaaaagggtcagagagtaaatattttaggctttgggggccgcatgatctctgtcacaacccttaaactctgcagggcagcacagacgcggccacagataaacagaaatgagtttgtgagttatggctctgttccaaaaaccctgatggtcctaaaatttaaattttatatggttttcacatgtcacgaaacaatatttttctttggatgtttttcagccacttgaaaatgtaaaaactgttcttagcttgagggctgtaccaaaacagggggtgggctagatgtggcccacaggccctggattgctggcccccgctccagaggctttacatgtcttagctcataggaccctgatgagataggcagccctatgttcagatgaagaaacggagtctcagagagactggaatcctcgggcaaggttccacagcagaaatagtagatattttagtctttgtgcaccatttggtctctgttgcaagagataactgtgagatttgaactcaggcagagctgggctcagagcccctgttattaaccacagtacactgtctcgtggaagccacacaggccacagatacaccacatttcagaaccagtgaccttatctcttaaaaccagaatctctgccttcatatgagcctaggtgggaaaggctgggctggtcaggcaggaaagacagtcttttgagcttagagggtggagggggcttctagggccattggccacctgagctgcagccccgggcacgctttgcagtcccctttcctgcgctgaccctatctggtaggggtgagcctgcctgagtaattaggtctgactgctgcaggcccgctgaggacttcacgctcccaacattctcctccgtcttattcatgtttggtatttttattacattattttgacatgacattccctaagtgacattcagctaaactgtgtttttgtagaatagggacttgccactctctcggcactgctgcattcatgatgacagccacatgtctgacatctcccccagggtgcaattacatgttgacaaaagaaaactctgaaaaaatttagtgtggaaggaaaaagctcaagctgccttaattaataagttaattaattttcattcatttgtactgttggcgatatagtggtgaacatgatagtcaagattccttaccacaatgaagcttactttctagtaggggagtcagacaataaacaaataaacaaggtaatagcagattgtgataagtgctatgaaggaaaaaaaatactgagatgggatattaagtggggcagaatatgtccctgttatccaacctctccttttcttagtgttatagatccactgatgtgcattgggaaacatactgcccagaatagagactgtttcccagcctcccttacagctaggcatggccaatggatatggtagaagtgagcagatgcctggggccttacgtgtccacaggcatagaagcgtgcgcctggcacttgctctttccctcttccaccagctagaaattctctctctcatacctctcttatctctcttttcctactctatctatctatctgtctacttatgcaccatctatatgttcagtaatctgtccatttgttcatctgttatctatccatccatccatccatccatccatccatccatccatccatccattcggcaagcatttatggagagcctgtggcagattctggggatgcaaaaactaaataaactcaatctatcccctcaagaagcccagagccccttcagcagagtaagcacctaagttgctttatgaaacataacagaaatcatagagttcaaattccactctgccactttgctcatatgacctcaagatagtgactttttacccctttgaaccttaactttctcatgaatacaatggagatgataatctctgcctctgaagattcgatgagatcagaaaggtagagcactttttagagagcctggcacacagcaggcattcaaaatactcttcttattagtctacgtgggaactggggaagtttcttggaggcttctgggcttgacataaaaggatgaaaagaatttggatgtgtgagattggaagaggagaaagggaattctgggcagagggtacggtaagagcaaaggcaaaggggcagggaaatttagggttcatcgaggagccagtgagagaggtgtgcctccctgagcatttccctccctgagcattctcctggcagcaggttccagagactgaaaaggacagggacagggtggggtgggggtgattgacaggctcagaggggtgaggacctgcagtccaagtgacccaaatagccacgggcagagagaactgggttatgtgcattaatctccaccccgggcaggctcccctccaccctctatctgggctctcgggccttgctgggtgggaggaagattgttttgacacttggatgtcgcttgggcttctcaaacttaacaaggccaaagagctcttgatcccccactacctgctctgtactatgttttgccttttttggcaaatggtgcctccatcctcccagatcttcaggctgtgacccaagagccctcctcgactcctttctgttcatcggcaaatcccatgggttccaccttcaaagtagtctgagcacttctcctgcctccccgatcatcaccctgggccaggcccctgatgtatcctaccaggactgttacagtggcctcctcactgctgtccctgtgctgtccctatgtcctccctcacccccgcagtctgttttccaatcagaacactctttttaaagcatgcattgatcctgccactgccctcctcaaaagcccccagtggagtcccagtgcacctggaatgaaagccagcgcctcacacagccttcaagaccctgtctgatctggccccggctacctctctccactcacatccaccagctgagctaaacctgctgcagccactggccctgctgctcctccaatatcccagactgggtccagcctcagggcctttgcacttacagttcctgccaggaatgctcctctcctagatctctgcaggtctttcttatctttcagcgttcagctcatccgttatccccagagggacctccctggccaccctagccactttatcctcatctattatctcatgaccctctttcagggttttggaagcactcatcatttccttcttgacttggtaattgtctcattcactagaatgaagtttccctgagaggacaggaactatgtctgtcttgatccctgtgcaacactagctgcctgttacacagtaggtactcagtaaatgtttgctggatgaatgaatacacaataccttccctagtggggatgttgaagcgacctctcataactagaaacacactcaacgggagcattttcgagacatctgagtggtgtggcccctgaagatcatgggagctaccacacccactgtacagatgtggaagctgaggtccagaaggaaagggaaggaacggggccccaggcacatagccctgccagagcagaaccaaggctgggacccagatcttctgcccctcagcctctcaggcaggcactggttcccagtccttgcctcatggaatcttcctgaaagcccccgaagtttgcagatctgccctacttcagccgctcatcttcccctgctccacgtggagagctcttctagatgggttggtttctggaaagcccacaaggaaggagggaaatgcagcctttcccctctggcgcctgtttcccttggtaactgtggggtatgggctgtgggcaggtgtgggtgtggagaggagagatctccagggtaggggtttgtgctgcctccagggccacagccaagggtggcccagccccagatgcccctaccagcctctttcctgcatcctgccagaccctggctgccgggagctctcattatgccattggcagccacatgaccctccctcgacctcacgaagattctggatgggagttcaggccatattcaggcagggtcaggccacagttcacagctcagtgtggtcatgtagctttggaatggcttcttctctctgtgagcctcagtctccccatgagtaagatggagcaaaacccaatgacattgcagggaaataaaaaggaaaatcttcttgctaccacaagaaatatcagcaaccacagtttgagcacctgctgcatgcacttgcctaagtactttaattgtagctttcaagccttctggactggggaccagagtaataaatatagttctaaaaaaaaaacccggcgagtacacataccctgaaataaacgctccacccacaagacgtatccccatgatgataatgtactctgatactttctgttcttgggttttcagtggtggttgtgatcccttagattgattttatgaccatcagtttgaaaagcactgtgttaactcatttaaacctcacaaaaccctataagagaagaactattaatatccccattttatagatgaggaagcagcttcagaggttgcgtcactctccccagtaagtgatggagctcagaggccaccgcagtgctcatatccttaagcatggtgcatggctgcccctttaagtgctggacctgggtaagaggggccccctcctgccacagggcagatggaaacctttcctcgatcctctggcaacttcccttccttggctccgggcaactcctcttttggttttcctaagcaagatgtcaggttagtaaaacagatcccagagtttaattaaaataatgagtggtattagaggaaggatgccagggccagccagagggagaaaatgagttacggttttgttcatggagaggggcggagggagagcacgagcagagggagaaagtctgtctgactctagaaaggcaataatgtttcgatgtggttttgctctcactcttgtctcctctgactcctccttccagagaatcccaaggatctttctataagatctaatcttgtcgctcctctgctttagagtcttctatggctccccagtgccttcagaataaatccacacttctcactgaggtttgaaggccctacgggatctgagtcctactaacggcacccctattgccatgcagctccctgcttcccacaccattccgatcccagaggtctcacatgggctgtgttctctccctactcctcttgcctgggctaactccagctcttccttgaaggcctgtttaaatgtcacttggggcatagagctgaacccaaatgataatacatgcttcctgtgctcatggttcagaggggagacagacaacacatacataaacgcataaaaggatagatcagccgggcacagtggctcacacctgtaatcccagcacattgggaggccaaggcaggaggattgtttgaggccataagttcaagaccagcctggggaacatagtgagacccccatttctaaaaacaaaacaaaacaaaacaaaacacacttaggtgtggtggcacacaccggtagtcctagctacttggcaggctgagacaggaggatcacttgggcccagaagtttgaggttgcagtgagctatgattgtgtcactgcactccagcctgggcaacacagtgagacgctgtctctactaaaaaacaagacagatcatttaagacagggatcagcaccaggtggaaaggcaaaggactaagctttttgaggaccatctgcccggcaccgttcagaatggcttgtgtgtatttacctgttgaatcttgctccggtctgagaggtggaagctctatcacctccacctcatgaggggatgagctggaaagtaggttgctcacagcttctcctgggttccacttgagcagcctggctttggaactcaagctgttaaccatcgcccttcacggtggctccaaacattgaggggatgggacaggctgggtaggtggtgggagaaagaaggtggggatgcaacttgatattcagtggcctgagaaggtgacctgtgagctgaacagtgggtctggccatgtaaggacagggggaagaataagggaagcagcagacgccttgagaatataaatacggcaaagagcccaaggtggctgaagtggtggtcccgcgagttcccatccacctgaaatgtgattggcccaggccagcgtgggtattgggagaggccatagctaagtccactgaaggaagctattggggtggtgcagggggtgggggctgtgatgctgtgagccccagccttgtgacagagcccacggctctttcctctctgtaggtgatgctggcaaaaggcctaggggatccagctggggagggactgccagtcttcccagcaaccaaaatttgggggaggaccacgcctatctcttggaatatcatgttttttcgcttatcgtattggaggcttcattcattcattccctcccatctcaccaaatctcacctgtcccccaaagtcctctctaacctcatctcctactacccttctctcacatggtcccatgcagccacagtggccttcttgctgttctcccatagattgagctcatttctaccccaggcctttgcactatagctccctctgcctggaatgctcttcccccactctgggactgccctcctcattcaagcctcagctcccaggaaggggttggtgtgggcaaaagggagtgccattccttgcagacctcacaatccctaaggatctttattttattttattattgttattttaaaggcaggatctcactccatcacccaggctggagtgcagtagcacaatcatagctcactgcagcctcgaactgctgggctcaagggaacctcccgcctcagcctcctgagtagatgtaactatgggcaggacccaggcgcctggcttctaaggatcttaaacaagagttttcatgatataggtataagattattcactgcagcattgtttattcgatcaaaaagtttggaaacaacctcaatgtccatcaacagggaaaaattaactcaacagagggtcatttatatgcagctgtaaatatgaacactatgcagctgtaaaaagaacagagatggctcaatatgcataaatagggaacagtccccgaggtatgctgttagcaagcaaagcaccgcgagaacagaatgtataacaaactcccatttcaataaaacaaggaaaaaagaatatgtacatatatgcattcacttatatatggatatgttatttgtggaagcgatcacaggaaattggtaacagtggctgcccctggggaggaggacggggtggctgggggacagggtgggagagaacttttcactgtgtgcccttttgaacactttgactttcatactagggaaatatagtagctattcagaaaactgacattccagtatttttagaattttgaccttatctctaaatgggttaggtacacaaacagggacagaatgataacaacgaaaaaagactgcattcctcaaacaacactacccctgcatcccttactgaaccactcctagagaatgccatgggtttaaaatacgaatatataaacaaatcgaataaatcctggggttatcttgtgagttatgtgagttacacatttatattatgttgtgattttatgcaggttgtcacgatttgctcaatgttacatcttaaatgtactgcaactttagggatgtcttcattttgttgttgttttctttataaattaatattccaggagtctcaaaaaaatagaagtcttccaggcttctctccgctggagggaccctgtcccaattctccttagggagtgaaagagacaagggaggcccgagaacagggacagtaaacccgagttctcaggaggaacagcagcccacagtcccaatttaggtgctcccaggggatggggacaggctgaccaaggcacagaggcagggccaggcctacccctggggatgtagatctgctgaacatgggcaagagaaaattcccaccctgtgaagctggtcttgctgcggactggaggggaatgtctgtggtttttaagctgtctcctctggaaacagcatctcacagcgccgagctaggagtgctacccagttctgaacaattccagagcccaggctttttagccactaaatcaaagtgagagatgttgacttagtgtagccatggcctgatctgaatcgacgttaaagtttcccaacagcccatgagatggtagaaaggatgaaatgatactattaataatgtacacacgcttaactcattcatgaccatccccctgcgctggcttcaaaccctgtgtccagcctgtatctcacttgattctcccagccaccctaggaggtagcagtgttggtttcattattcccactttacagacaagaaagctgaggttccgagtggggaaggaacttgtctaaggtcacagagctaaggagtgtcatgcatagagtaaaagtctccaatccagagctccctctgattcaccacctggggaagccaggggtgggcctagctcggtgcctcagtgcccacggcatggatgggagaggcccctcatcaccaggcaggcagagtgcagggcagaggcggatgactctagtctagactgtcctgctgaggctggtgatgggggaggctcgctgagccaccagctacagggagtctcagaatatctaccacatcagcaagaccttccagatctgcctgcaggaggcacctggaacatgcccacctctcaccacccccagagatctgccctgggccaggccacatcctcttctacctgaatgattgtagttgcctcctcactgtctttctgcttccatcctggcccgtacaataaaacacagtccattctccagattcatccatacggatcctgttagaacctaagccagaccagggcacttttctttgctcaaaacacctccctatctcccagcatactgaggacaacagccaaagtccttagaacagcccacaaggctctgcagggcctggcccctccgtatctctctggcctgatcccctttactcctccccttgctcactcccctccagccatgctggcctcccctctgttcctggagcacaacaggcatggtctggcctcagggcctttgcacttgctgtgccctctgcctagaacactccagccccatatataggcctgtttcctttctttgtgtctttcaggtctctgcttaaatctcacatccccagaatggctctccctgaccactctatttcaaatggcacccacaccccatgaataccagtccccttactcctgacattttgcatatatgcagtgatattatatatttgtctcttatttctttagtgttctccttttgcttctagaatgcaagctttaagagccacaggtctttgttctttttcttgattgtattgttgtgtccttcatgcctagcaaggggctggcatacagtagacacaaattaaagaacaaacaaatgagttccaggtctccaggcagactcctcaggactccgggacaacagagagtcctctgaaatgtctcatgaatctctctctccatgaaaggcaaacccagcattacaccatgggttgggcagtttatggccacatgtccaggtggctgtagcaacaatactcattagtcagtgtatttttgtggttgaaggcaaggtacactctgtttcctcaaggtagtcaaacaaacaccatgagaactatgtggagcttgaaggaaactgtgagctccaaactttcctgccagaaaaggaaaccaaggctaagagaagtaaaataccttgcccaatgtctctcaccactaagaggaaaagtcagccctcaaactctggtcttctcaccatgaagccaagaaaagatcctcagaggacactggcactggtgatttgttgttaagacaaccatgcagataagcacagccctgctgatcagggcctgagaaaaacaaggattctaggtcttccaaacaacaaaggtggccagtcatgcagcaccatgagttcagggtgaggttacaactcattgtcaatgtgttcctggaagacatccagagagctctggacattttctcctaaaagctttggtgagaggagagggaagacgtgtttggaaacattctctggactccattaaagcagatgttctcgggacccaggccaccatgtgcatgatgtcctgctgactcacctgtgggtctccccagttcggagaaaacacgtggccaaggctgggcaagaaggtctggatttcctgcacagcccttcaaggaggtggggggtagggacactggcctgaggacagagaacagacaagctggggaaccacttcacatttggcctgctaggccacgtgacatttggccgaaaccaactttggccaatgtgaagttctaagaaatatcttgttctgggatgagcacttatggtgtaacagtcctgcagagcattttcttccaaaaccttctggcctactgacatgccatggacttgccaaccatgtgagtctcaaaacataatccccacattctctgccattcctccatcaagagacaaggcttttgtctcttccctttgagtttgggctctgcaactgcttgttcagtagaatatggcagaaatgacccagtgccagtttcaggacccagaccttgagaaactggtatctttcacttcctgctcattggtatgatcactcttggaaccagatgcctcctgtgaggaaactcaagccacctcatggaggggaactgtcagacagcaacatctttccagccctgcgagcaagtgagccccagttgagccgccccggtggaggctgtgtgcagagcagaaatgaaccaggcctgtccatcctggcccacactgcagattcacgagcaaataaatgttttgttttaagccactaagttttggagggtggtgtgttatgtggctgtagagaaatagaacatcttcccaactgggaaggaatttcctgggccctgcaggaacccaatccagatgtaggattttaataataacagagaggcctggggttattttaaggaagaccaataaatcaggtcaggaaacatcatctgctgacttccctctggcactccctagccttgtcaatgagaatagctgagaacagtctaggagtcttccctatttgagatagaatcctctgctaatcaaacacacctcgggatcctctatggccagggtggaggtggcaaaagtggagaacaaatgttttcccttaattcaggatcttatatatttttcacagaatgtggaattacctggtggctatcgtcctacttggactatcaaaggaaataaggccgctctataggcaagcatcagaaacctctccttctattcctttcctgttttatttattgtgtggggctgccatggagatggagctgggaagagacaggggaagttcagcctacaaaatctttgtgaagctgggtgcagtggcgcatgcctgtagtcccagctattcgggaggctgaggtgggaggggtgcttgagctcaggagatcaagtgtgctgtgagctctggttgcaccactgcactccagcctgggtaagagaatgagaccccatctctttttttttttttttttgagatggagtctcaccatgttgctcgggctggagtgcagtggtgcgatctcagctcactgcaacctctgcctcccaggttcaagtgattctcttgcctcagcctcccgagtagctgggattacaggtgcatgacaccatgcctggctaatttttgtattttcagtagagatggggttttaccgtgttcgtcaggctagtctcaaactcttgacttcaaatgatccgcccaccttggcctcccaaagtactgggattacaggtgtgagccaccgcgcccagcctgagatcccctctcttaaaaaaaaactgtgaatgcctctttttgttggagtagggtttggactggttctttgcttgcttttcatcaaagtgggtttgtcatgtgattttaaaagtctctaaaactctgcctgccaaagtatccatctgtcttattttatgttagctagaacaccccaaggggccaggatggcaggacaagctccaaggggtgatgtgggcaatagcagtcaatgtctgctctacacttgatggtgcacaagagcttttattctcatgatcttggaatatcctttcaggaatccagtgaaggtgactggacaaaaactatggtatgcctgtacaaaggaatactactcagcaataaaatggagtgagctactgatgcatgccacaccatggacggacctcaaaaccatgatactgagtgaaggcagccagatgcaaaaggccacacactgtatgatgccatttacgtgaaatgtcccaaagagacaaatccatagagaaagaaagcagcttggtggttgcctgggcctgggtgaaaggggtgtggggagtgaatgcaaattggcatggggtttcttttggaaatgttctgaaattggattgtagtgatggctgcacaatgctgtaaatttactaaaaattattgaattgcacacttaaaatgaatgaattttatggtataaagttccataaggctgtttaaaattttttatggtataaagctatttaaaaaaaaaaaaagaacagaggggagtcagagggaggggacaaggggtggagggtggagttgttagagcttcatggggcataggagataaatggatatgtactggctggaaaggatagaagctgtgattttcttagtcacctaactggggaaatcccagaacaggaggcctctgagttcctactagctgacaagtgataaaagctgagagtaataatgacaagtgctaacactgattaagtgccaggcacatgccaggcaactatacagagcatgttacaggtatgaacccatctgctcctccaagaagccctttgaagtggtattgggagataattctccatgggtctctccaaggtctgcatgtcttcagctcaaaagacactgagacctttgttctagactatcatctcaaggacatctgtgtagcaaacacacttggaggacagagacaatatctctctctggagcagaaagaagaggatagagttgtttcccaaccagtacaataatgtctctatctgaggcaaaggctagacaggtttggcaatagcccctttataagattgcaggtttcctaagctctgggatcctccattgagacacagatctgctgctgtgtgtgcagaatccatttgggttgttttcattgctctcatggaacttgggagacaattagaactgacgcaaatatgaagcttgtgctgcttgctatactgtgactaataaagtcctttgtctctgacctgggatctcgtgtcttctgccgtcatgtatggcattgtggcaggctaactcattagcttgtgagcagtgcaaaatctcggacccttcgtagttcttccgtcatactcacatcacccctgttttacagatgaggactttgaggcccagagaattgaagcttcttgttcaagatcacacagctaacaagtaacaaagctaggactgttacccagaccgattgggaaaggaaggagagatgagtaggggattggagaagagaaccgctggaaatgacaggagctgaaggccccaaaggtacacagaaggtcatgcctctcagcttcccaaacccacacacccccagatgctgcctgtccctacatccggctgctggggctgagcagccaatttgggacgaccgtgatatatttaacggtgagtcatgctctcccccagcaatcagcagtggcaggctcgggaggatgcagggagcatctctggaaatccgtgcctgagggtcgccatgacaacgccatctgagtcgcttgccagcagctgggatgccagtgcctgaaccaaggcacaaaatagtctcacaggctgagtgcggccgaggacaggagcaggccccctgcacggcatccccaatgggtttgccagggattgatgggagggatgtgaggacttggtgacaagggagattcatgggctcactgtccaggtcacagtactctatggaagcctggggtccctggctggtgggaatgagcacacttggcgtgatgggtattttggtgagcaccatctcttcctgccttggttcttcttggtttgtctgtctcatagttgctctcccagaggccctgcccaatttgaggcttctatccaagtgtcacaacctctgaagactgacagcaacttgggaaggtaaccaagatcatcttccaggataattctgaagacttcagaacctagggcgaatcagccacacccacacactaacaccaaatacgaatatcccatgaaagcagcttggaatccattcattcattcataaatccattcatcaccttgtcctctcagttgttcattttaattagaacctgggtcctacaggccctatgtagaagtggatttggttatcccgtcctcatcccctttcactccccctctcttattctactctagctcactagtcttactgctgttcctcaaacatacagttgcttttctgcctcagagcctttgcacttgctcctccatctgcctggaaagctcttcccccagaagggaagctctccctttaggtttctgctcatatgtcaccttctcagagacacactaccaagaccaccctaggagaaagcacctaattcagcctcagtgataaggccaaatatatatatatatatatattatgtataatatgacatatatctgtgacttagtttcccccatccgtacgaagcaaagagagacaagctgaaaattggtggcctgtaagttgaatctaactcacagacctgttttgtttggtttacatagtgtttcaagaactgagcaagttgctaacagttataaagttgagagattttgttttagaatgcaaattttcaatttatctcgaaaaactaaggttgggtgtggtggctcatgcctgtaatcctagcactctgagaggctgaggagggtggatcacttgagcccaaggagtttgagaccagcctggccaacaggacaaaacctcgtctctacaaaaaatacaaaaattagctgtgtgtgggggcatgtacctgtagtcccagctacttggaaggctgaggtgggaggatcacttgaggctgggaggttgaagctgcagtgagccatgatcatgctactgcactccatcctgggagacagagtgagaccctgtctcaaaaaaaaaaaaaaaaaaaaaagaaaagaaaagaaaacaaagaaaaatattaagctgtgcattctgcatctgtaaaagcaactggctgaggcatgagcattccagtgccaaaggccctatgtggacctcttcattcatttatgtggccatgttctacctatgggagtctttgggcttgcagcccaagtctctaatccgaggtctctaagggtctttggtttgggatggaaagagtgtggcatagtggttaagagtcaggccgatggggctgcaatcctcactcacttcagtgttcacagcttcagtttcctcacatgtagtatggaatctcagagagttaatgtgcgaactgaacaaaacaatgtacctggaaaaatgcttaacacagagcctaggaaatagaacacaataagtggaaacttaaaaaagagctttttctggcctttaatgacagtccattccttgatctgactcactaggtctcttcgatcagaaatttgggagacaaggaagggctgttttgctgcaattcacttgatgtcaaagcaggaaagacctcggacaaagcttcaagtctaaccttttttgttctcgggtgagtaaaccaagaccagaggatgagtcttgcccagaagagtttctaaccattcttcccccaggtatttgtttcccggtgaaatttgcttaaagttggaattggctgagtgtgggccagagctatgggcattgttgtgaacacttgcttttaactgcccagtatctacttgctctttatctgtaacagctccctgatttttccctggcaccatccctcttctgatccccaggaaatggctccaggtatgggcatgtggttcatgaccacagtggttggctcagagatggccatatgatgcaatccaggccaatgcatgtcaaccacagagctcttaggaactactggtacccactggagctgctgggctggttagatacaagcctggggctgctgagagccatttttgctatgacttggggagctgcctgcgaggatgccaacacaaaggaaaaaaggtccaggtgatggaggaaaacagaaaccttagaacataatttgagcaacttgattcagctgagcctgaaggcgtgtacccctgggcttttcagttacataagccaatcagtcccttctgccttcctctttttttgctacgatcagttagaatcaagattctggattcatccaggcatggtaggtgaaggtgttgggtaagcaaaggcccagaagcaggaaaatgcagaacaagttctgggatttccaatgaataacctgcagtgggaagaggccagtaaactcacttaaagccagaacctggggagctttgaatgccttgctaagtcactttgactttatcctaagggtaacagggagccatgggaaaggacctgccagagttggcaatggtgtggggcagtgggagtgaggattattctggatattaagtctggttcagggttctcctgggatccaactccagcccagagtgcatgcagtggtgagagagggtgtcttccctcagcacccgcagcttccagtccctcctgactgtcttataataacagtgttttcaatgcagaccttctgggttccctgccgcgaatcactcagccacccttccagggagaaaacaaaaagcagtgtttttccgtgtctattttaggctgctgcctacatctttgttcttcgtgaggaacacacactcccggggggcccttttctcagctgtggcccagcagtcgggtctggaccaccaggctgggttccgttatgggaaagaaccagcagatgtaatggaatcatgccaattaggccaggagctgcgtggggatgatgttatcattaagttccagaagacgtggaggtgagggggaaggtagctcattcccgtccacatggctatcccagacggactgccttttttgatctgtccccttcgactatcctgagcagctaggaagagcccacccttgctatcccctgagggacagaatttagaagtctgcattgtatgagacacttgtgctcattttactgttgggctgaaagcagaagtagaaattctatggcaaatgggtggatccagcccacccattttacagatggtaaaactgaggcctgaagaggaagcatagtttgttcaggtttatagaacatttggtggcaatctatgaccaaaaagaccagaacataaaatctcagagggcatgtaccttatctgtcttggtcaacatcgtgtcccatcacaaaacatagtacatggcaaataataggcccttgatatacattggatgaatgaacaacatctctactgctgttttcagctttcacaaagaattctctcacacattccctcatttcaacgtcatgattgtctttgtagccaagaattgcttttgtccttattttgcaggtgaggaaatggaagttaagagaggcttagttgcctatccgagatcacacagcctaggtagagactgaatttgaatccatgtcatcttgatgcaggctggggcatcacttaaattttggtagaggaagagaccttggaaatgtccagctgggaggtaaaagccttggtctacaaggacaactctgactttaattatactacaacatttggagtgaggggaacaagaaagcaggtcctcaaaaatgttcaaaagagttaccatatgacctagcaagtccacttctaggtatacatccaagagaattgaaaacctatgtctgtgcaaaaaattatacattcatagcagctttattcataataaccaaaaagtagagacaccccaaatgttcatcaactgatgaaagataaataaaatgtggcctatccatacaataaagtagtattcatccataaaaaggaacaaaaacggatacaagctgcactgtgggcgagccttgaaaacattttgctaagtgaaagaagttagtcacaaaaggccccatattgtatgattccatttatgagaaatgtccagaataggtacacctaacgagacagaaagtatagattactggttgccaggagatgaggggaggaaggaatggggggtgactgttaatgggtacagggtttctttttggggtgattagaatgttctaaaattagatgtgatgatggcttcacaactttttgaatatgctaaaaactattgaattatacattttaaatgggtgaattttatggcatttgaattataccccaatcaaacccttaaaaaaaataccaagaggagcatttccatggcaagggagttttagaagggggaacatacaaatgaggaagggtccccagcatggacagctccatgctgtcttcttggatgtcccaggaagaatttcaagaaagtatttcaacccccagctccaaggattcacctgagggcttgttcctatggagttgagaatctgtaggatacctcctccaggtaactctcccagatatcccaaccacagacaagaaaatgaactcatgataactgggcaccactcagtgccctggtgctctgcttgtgatatctcactgaagccatgcaacaaccttgctgaatgtgaggtagtaccatcacccttgttatccaggtgaagaaatggaagctcacagagataaaatgacttgtctggggtcacacagcttttggctctctcagctacatcatagtgcgtgggacacacccagagtaaggcctgaggccactttccgagggaacccaagcaagttccttgacactgtgggccttagtttccccatctgttccattaaatcccagcttactccttcattgtcctggtgggggcttcagccagagcatcaccacctgcctctgatataatggtgcttcacatttcatcagatttcatgtgaacaaagccaaacatcttttctcagtgcctcacctgcccagggatcctagtccacatctatgctgtttttctccactctgtccttccagtgcttggcacgctgtgccacttctcaaaaaaccctgatgttgcctgccattgggttcaaggcagatgatgtgatttcacaggctttcttcttcagcactaaataaggtgcttttgtggggcccttcctttacttctgatgctttaggttcaactttggagtttgtagacttgcagagaattttccatcaaagcgtacaggcagagatgcaaacacacacccttttatatctccatccatccatccattcattcacccatcaatccatttactcatccatccatccatccatccatccatccatcatccatccatccactcatccacccatccatttatccatccatccatccactcatctacacatccaattgcccatccatccacctactaatccatccattcatccactcattcatccatccactcatgcatccattaaatcatatattcatctactcatctatctacccattcatttattttcccatttcctttattcattcattaattcaataaatatttaccaaaagccgactatatgccaggcaccatgttggccaatggatacagtggaagaaaagacaaaatgaggttcttctcctcatggagctcacagtccactgaaggaagataggcctcaatagacacacaaaatgtaagcataaattgggatgaatgctaccaaaacaaagtccagaatgataaagatgcctaatttccattgggagatggaggaggcttttctgagaaagttgacatttaagatgagatctgaagtatgatttatgatttatcagttaggaatgctcttggtttaagaagtagaaaatgctaaccaaaagaggctccagcagttagggttatgatcccacataaccaaaagtcctgaaatagggttaccccatcactgagggacttgacaacatagttaaatatccagactctctaccatctactctaccaccctcagaggactggcttcattcccaggctggcttacttcatggacacaagatagctgcctctgctctggccatcaggtgaagacatgcccacattcatactcagaccatcacgagcaaaaggaatggggccaccatgattgtctcagatcagctgtttgcaactggccctgattttgcaccccaggggacgtttagaaacattttcagtggcataattatgtgtgtgttttgggggcattgctactggcatcttgtgggtagaggccagggatgttgctaggcatcctacagtgcacagtacagaccccatgagagataattattcagatgtcaatagtgcctgctttagaccagttagaacaaaatcctgagtcatggggcacacagtagaaaggcgtaggggaattgcttaagaaagctttcctggatgatgtaacagctcaactgagtcttgaaagatggacactggttaataaatccaggtaataaccagctggccacgtggatgagcaaaaacgcagcccttccctcttttctgcctcttctagtcgatgtgagccccatatggtcagggacctcacctgacccattcacttctccatccccattcccatttgatgcccattaccatagttgttcaacacattgttgtcaaagaatgagggactaaaatggggagaaaccctctctggaggctgaagccccaactttgaaaattcctgggagtcacacagagtgaatgttgggggcaatgactctggaataagtataggaggatatcagtcaacatgaggaaaccccaagaaaacatttggttcagtcctatcattgtacagatggggagactaagacacacaaaaggggagaaaatggttcaaggtcactcagaaagggggtcagacacagccagaacccatgtgcccctttcttaacccgtgatcaacagcagctggtggatcctgaacaattgtttagagactcacggtccagctgaacacagttccgagttcctgaatttgggcgtttcccacctcttatctccttagaaagctttcttcctggattcacttaccttgggaccccagaaggatgctgagtggggccaccttctgtgagtgtgtactctgctcagatggcaaaatggctaccaaactgcccaacccaaatggccggttcatggacacgttttgtttggtccatgtttgtttaattcttaaaaaaaaattattatttgcattctttgccaacaataaaaataattgggacagtgtgccttaatccaaatttcccacttctcttcggtaatcagaaggtttgacagcattgtgcccatttttctgcatggcagctatttacaggagttgggcagtggctgctccttttgtcaggatacaagtgccccatttcatcccagtgccctcctggctatatcactcttgtacagggctgcctggccccagcccagctgatgggacacaggcgtgagtagtgaggccatgcagggaccacaagcaggacactctccctctctcttggaaggaagcaccttggttaccatagcaacatgctgctgtttgtaacacatcttccacctgaaaaggagaggagatgacaagtacatctctcttctcagcccaggcaacatcagctcctggcaccccccaaaacctaagagcgagaagggggagtgtgatctgtcttctccaatctgggccccaaatgcagatgccccaaacacccccatttgttcaaccaacccagagatgaggcgttgggaggggttgatttagattccatcttatataaaaagaccagaacatttttgattagtgatggaggaaggtgtgggagtctgagacagtgctttgtttctgggcaaatgtacacattccctgatgcctctcttctctccacgtcctctaaagtagaagcatagactccctctccttactactcctcacagccaaattcccctcagccaggaccccagacctttcccaatacccaggagcccctagggcagcaggcctgtttctaggctacctacagaacctgaaggaaataagggaatgaaataagagaatcagccagaaataaggcagggcaccgtgcggtattttcctttgaaactaagaggctgagagctggaacagcagcagaaatcagaagaaatctcattgagaaaagaggcacagagaggagtgccaattagcacccaggtcccctcctgggagtgtcaatccataaatattaataaccgtaatcatccagtattagttataatgccttgtaaattaaggtcattttccgtggagtaaatagctgcgttaatggcagcaaaaggtaacggcgttgctggctgcatgccagttgatgcctgccaggatgacagtataaatcaggaaggacacgtccaatctgtgaagacaggcagtggcatgggggcaggtggagtgacggggcagagtgtggccgcagacacacatcccacgcaaggcccttgggccgatctgatctaacagggacctgctttagacaggtgatgtctggggcagatgaagctcccagggtcactaggtgtaggtaggaggggagagaaggggccgggtgggtagggagagggtgtctcagagggaggtggcaccaagacttcagacacttgggttaagagcagagggccacgctttgagctgctgcctgtggcatttcactgcagaccttggcgcctttgctaagcgacacagacattctcttcttcctctacctcctttccctcctctccatcttccttctcttcctctcctctcctcctgccagggctgacttctccattaggcccaatagacacagcctggggttcacactacctctagggccccttctccaatgttttaatttcttttataattagaagaaaaaaagaactttcagcaggaagaaaatgttgtaatactgtatgtgatattaatatattcatctttataccaatgtagccataatatagcatgtttgtttttttttcatggagagaggcctaagtgcccgggggccacaaaattcatcacatggccctactttctgctccccacccctcctcccactaaccacggggccctaagcaattagcattgccttatggagtctcggtttcatcctttgcaaatgggctaataatggtgatgccttcccaagcaggatgaagtaaaataatattagaaaaagctttggccacaaagtggtgtttgcctccttttcaggaggctctgggatcctgggagttaggcgggtgatgtatttgaaaatctcagtggatggagtccctggtaatgctccctatgggctccccaagctaaatgcaccgtcagacccttctctcgggtctgacccatcatcttcctgggctccctggtttctctaaagagcaaatgcttttcttgaccctctgagaaaactcacaaggcacttgagtatactagatggatcaaataatgcctttaaattccaacggaaagaaagcagccattatgacgggctccagcaaggggagggagttgggggcctccttgttcctttactgctgggactggacacactggggtttgcaatacccagtgcagatgaaaatgtggggacccttgttcaaaaactatggatttcatgacagtgacagcagagcctctaacaaagtgtggggcccttctgagaggggcgtctggtactactgcactggttgcacacccgtgacaaagcctgttgttagcttgcagctgggaggacgggtgtggcagtggccggggaggggacagcagtgatgatgatgctgtttgatttcccccaactccaccttcacctagtacagtgcctggcatgttgtaggtgcctaagaagttctagttcattctctcattcccctaacacagggcccaccatggcagatgaggcctgtccccaccagggtggaagctggatcactgggcccggcttggcacctggtaacgatccctctccagggggctgtgccctggatcctctctctcctccctcctccaccttcccccagaaagagtgatcctttattttactcctggcctatggtttttgtgttggcagaagtggaggtgcttatggccagcatagcctccaaactaaacactgcagaagtattgagtattattattatttttattatctaaatttgcaaactctgccccctcctattactcagctccttccttttcttctttacttttcttcactgcccttgtcccctcctgatattatagtgcatatctatctgcttgtgtgctatctgtctcccagaccgaagggtggactccacgaggacagggactttgtcttattcactctggaaccccagagttagcacagggctcagcacatcaaagacactcaataggtatttgtagaatgtacacacaaatcttggaaaggtgggcagggatgctgtgtgtcctggggccaggaagccacctctctgagtctccctttcctcacctgtaaaaaagaggtaacagcagctcttgcaaaggctgaggagcagatgaaaggaggccacaccctgcaaaggcactgtgagctggtgagggagtgcagcgatatcacagttcctagagcccggcctgcaaatctggccacagctgccagtcaacagcccaggctcggctaaggtgccataacttggtgcccaccttggattttcacacccagctggctactggccaccagatggcatagaaggttagtccaaccacctggcctgacctgggaggctgcccagcctcagagagcatccttcctagcgatcacctgggctctagacctcagcctggtcctggcctggagggcggtggagggggctcagccattcagactgctgtgtggactctcacctgacagcatgtcattcaatccactctgtcaagaaatactatgataacaatcagggaaatgcaagccaaaatcacagtgaaataccacttcacacccactaggatggctagaataaaaaagacagaacaagtgctggcaaggatgtagagggactggaaccctcatatatagctggaggaaatgtaaaatggcaaaatcactttggaaaacagtctgggagttcctctaaaggttaaacatagaattaccatatgatccagcaattccacttctaggtacataccaagagaaagaaaaacatatgtccacataaaaatttgtgcacaaatgttcatagcagcattattcatgatagcccaaagtggaaacaactcaaatgtccatcagctgatgaatggataaacaaaatgtggtatatccacataatggaagcttattcagccataaaaaggaatgaagtactgacgcatgctgcaacatggatataaaatcttgaaaacattatgctgagcaaaagaagccagacacaaaaggtcacttattgtgtgatttcatttacatgaagtgtccagaatagggcaatgtagagagataacaattaggttagtggctgcccagggctgggatggaggtggggagagatggagagtgactactaaggggtaggagtttcttcttgggatgataaaaatgttccgaaattgattatgatgatggttgcaccactctgtgtatgtactaaaaaccatcgaattgtacactttaatgggggtaaattgtagctttaatttaatgggtaaattgtacatctcaataatatctcaataaagctgttatatgtatatgtgtgtatggatttgaataaaatgcatttgtaaggcatctaatatgagccaagtgaagagcacaaaatctctgcttgctcaggaagctaaccatgaagagacagaggaacagatacaagtgcaatttgactcgaaatatgaaaagcgcaatttgactttaagaaaaataaagcgggctgggttagggttggccaggactggagttgctttagatggaggagaggcactgtggtccaaggaagacacactgaggaggtagcttttgaacagagacttgaatgaagagattgggtggggtggggcacagaaattgggtggaagagtatttgcaacaggagaaatagcaagtgcaaaggccctggggtgggagcactgagccagaggaagctaagaggtaaggagggagaactgatgggggctggaccctggagggccagggaggttctgccgagacccatggcttggttctgagtgaagtgggagccgtggagggctttgagcagaagagggacatgctctgacttaggtttgcaccaaatctctctggctgtgagtggagaatggactgtggggtggatgtgggcaggatggaagctgggagaccagtgactaggctactgaaatagaccaggtgagagacgaagggggctcggccagggggtggaggcggaggtgtgaagtggtcagatgctagttgtggactagcaattctatccatggaacctccacttgcagggatttttattgccatttaacttgacccagatgtcagctgagatcaaaagcttcctacctgatgaacagtctttgaatgcctcccaatcgccaaggtcaatcacagcccctccccagaacgctataaatgccggggtccttgcttcttctgtcccttgggttcaaatgtcctgaatccatctggatgctgtctcagcctctgccaccgatttccatgagaaactcaacccatcaaacatgttatcattctggcagacttaacagaagagtcaatagtagtaaacaccttgtaagattcttctccaggttagatgagttaatgtatgtaaaagcacttagaacagtgcctggcacatggttggcactcaatgaatgttcactcctattatttatttattttcattttagattcagggggtacatgtgcaggtttgttacacgggtatattttgtgatgcggaggtttgggcttctaacgatcccatcacccaagcagtgaacgtggtacccaacaggtagtttttcaatccttttccccctctccctcccctccttccccttttctggacttcccagtgcttatcgttcccatctttgtgtccgtatgtacccaatgttcagctctcacttataagtgagaacatgtggtatttgggtttccgtttctgcattaatacacttgggataatggcctccagctgcatccatgttgctgcaaaggatgtaatctcgttcttttttatggctgcagattgttattcttttagagacaggatctcgctctgtcacccaggctggagtgcagtggtgcgatcatagctcacggcagccttgaactcctgagcccaatccatcctcccgcctcagcctcctgagtagctgggactacaggaacgcaccaccacaccagactaatttttaagtttttgtttgtttgtttgtttttgtttttttttagagacagagtcttgtgatattgcccaggctggtcttgaactcctggcttcaagtaatcctcccgcttcagtctcccaaagtgctgggcttacaggtgagagccaccgtgccccgtcctggcttctgttattatcacgtggctagcgtaaggggtgttgggtaggtagctccctttctgggaaacattggccccatccacccacatccgatggggctctcccatttcaacaggtcttaagaagccatctcctcaacaaaagtgggcccctgggaggaattctcctgacagccactaaaacagtatgcttgacctgcatctcataacgcatccaggaggaaatgaaagcacagacagctggagaaccaggcccaaggtcacaaaacttaggtgtagcagagctgagaattcaatgtgcatttgatgctaagccaggtgataaaagaaggaaagccagttttattgagtgcatgttatattccaggcatctttgtatgcactgtgcttttatttatttatttatttattttatttaatttattttttgaggcacagtctcactctgtcacctgggctggagtgcagtggcgtgatctcggctccctgcaacctccacctcccaggttcaagtgattctcgtgcctcagcctcccaagtagctaggattacaggcatgtgccaccacacccagctaatttttgtatttttagtagagacgggggtttcaccatgctggccaggctggtcttgaactctcagcctctggtgattggctcgccttggtgtctcaaagggctgggattacaagcgtgagccactgtgctcagcctgcattgagtttttaaaaatttcactttttatataaattatattaattttgaagggcagtacctgcacacagtttgaaaatcaaaaaggtacaaaagggtacacagttaaaaagggggatcttcctcccgcccctgtcccctgtcaaccagctctctgcctcagaagtgactactattttgtttcttagggatctttccagtgacggactaggaatggcagaacctactagttgcccacccagtatccagcctccacctcctccttgctaacagaaccccaattttgctcacaggtggccatatgcccagataaaaacactcacattcctgactcccttgcagttagcagcagccatgtgacctggtctgtacagcgagatgtaggtggaagtccctgggcagggaatttcttttcactccctcaaaagtcaaagtgcccggaaaagaagacttttgtgtttttgttttgcttttgccctttgcccttaaaaaaaatttcttgcctgggtgagactccatctcaattaaaaatatatatatatattctgcctggaatgtggacttgatacctggaggtggaggagcagccaccttgagaccgtaaggatcagagacacgtactcagaatggggaaaggaaagaacgatgcttgagtccttcagcagctgcaccagtgctgcgctgcccggctctggacttactgtgtttgctcaagccatcgtctgttggatttttctcatccttgcagctacatgccttcttaactgaaaccgtgcctaaataagcatttgtatttatctatgttctttcttccccacaaaaacggtagcatatactccacctacccttcaggatcttacgtcttcacttaacaatatatcttgaaggttgttacaaataggtacacacagagctgccctgaacttttaaatgaatgtgtctaagaccttgtacagatgctccctagagtgttccaccaagtccctcttggtgtgggtcgttctcaacttcttgctatcacagataatactgcagagacaaaacagggacattgttcatatcccacatgtgagggtttgtcttcagaagaattgctgaatgcaagggcagatgctttttcagtgttcttagattttgtcaaatttccctgcaaagaagtctggctgacgtgcattccaccagcaatgtgggagtgtacccacacgttgtctctaatcctttcaacaacaaactagatggtgtccattttgctgaggctcagagaattgtacatggcctgcccaaagtcatcacaggcaactggtgagatggggatttgtaccagggtctgtctgatgtcaaagctgtgcttgtaaacacatgacattgcttttcaggcagcctggattccagagactctcagaaaagagggaagaacgaatctgacccaggcgctggtctgtacctgagaagagcctttgggctgggctgtggggaggcccgtgtttgtcctgggccgcgtcccagctcaggtctgtcatggccttgctgtgtgagcaagtcctgccccttaccctctctctgggcctcagtctttccacctgtcaaatggatggcttggagttgctggttcctaaaatcctttaatgttaggcttcttgaaaatccccaagtctgagggtatcttgggagctgcttttcagacctcaaaatggaaacagcgatttttcctctattcctgaccgagcagaggtcagcagcgtcaggggcatctacttctatctgtggactgaggtcacattccctgggggaggctgggccatggtggggcagcagtccgctgccctgttttctctgtagggtacatcttctcccagctctgacagccagattctgaggacaaatattccagttatggtttcagatactgagtattttccaaagtgatttacatatctaatctggaagagaggggctactcttatccccattttacagataaggaaacaggggcacagagagatcgatcaacttgtctgaggtcattcggccagtaagcggcagccaggatttggccccaggaagtctggtgcaagaatctgtgcccttcaccgagcatttctcaacctcgacctattggcgttttgggttggctcactcaggtagggggctgccttgtgcattctgggatgttcagcagcatctctggcctccacccactagatgccccctgggtatgacaaccaaaatgacccagacattgtcaagcgtcccctggaggtcaaaatcacctccagctgagaactatcttaacacagctctggagatgtggattctaggcccatctggggactcttgggtttttttttttttttttttttgagacagagtcttgctctgctgcctgggctggagggcagtggtgcgatctcagctcactgcaacctccacctcctgggttcaaacaattctcgtgtctcagcctcctgagtagctgagattacaggcatgtaccaccatgcctggctaatgtttttattttttgtagagacggggttttgccacgttggccaggctggtcttgaactcctcggttcaagtgatctacccactttggcctcccaaatgctgggcttacagatgtgagctaccgcacccagctgattcttaacccttctgagcctgcttcaggctctggaaagacactgacaaaggcctagagaagaaccttgcaagagggcaatgccctgtgcaggcgatagaagcgtcgcagggcagccttctctgaggctggcgatgggacaactcagcgaggggcattggcgggcagcaaagaaaaagcttgggtggtggaatgggcttggaggttggctgagtgaccttaggcaagtgctgagattctctgaccttaggcaagtgctttagattctctgagatgcagtcttctcagccaaaatcagagttaacccttgtagagttgaggtgtgatacttaaataaagtattgtcatgatgggtgaagaaaaacaaaaccaaaaactatatccacgaagagtctagttaaataatgtatggtacatctaagccatgaaagattatgcagccattaaaatgaatgaggtaaatctagtttttgctgatatggaaagatctctaaggcttatttatttatttattttttgagatggagtctcgctctgttgcccaggctggaatgaagtggcgcaatctcagcccactgcaacctctgcctcccgggttcaagtgattctcctgcctcagcctcccaagtagctgagactacaggcgcacgccaccatgcctggctaatttttgtatttttagtagagatgggtttcaccatgttggccaggatggtttcaatctcttgacttcgtgatccatccatcttggcctcccaaagtgctgggattacaggtgtaagccaccgcgcccggtggcttattcatttattaatagttaaaaagtaaggtacccaacagtatatatgacataatcccattggtattagaaataaaaataatctttctacatagccttattgagcacctactgcttgccaggaactggagtaagcaggaggaatacagtgtggataaaacaaaactcctatttccatggaggttggtgcaaaagcaattgcatcaacctaatataaagacgtgcaagaaaatggcttcttctgagcctggagatgtgggagtgagatttctgtctttccattgtatgccctctggtatttgaattagtcttactgttgaatgcatttatttatttatttatttagatggagttttgctctgttgcccaggctggagtgcagtggcacgatctcggctcactgtaacctctgcctcccgggttcaagctattctcccagcctcccgagtagctgggattacaggtgtgcgccacctggctaatttttttgtatttttagtagagacagggtttcatcatgttggccaggctggtctcaaactcctgacctcaaatgatccacccacctcagcttcccaaagtgctgggactacaggtgtgagtcactgtggccggctgaatgcatttattttaatgatcagtttttaaaagactggattaaaaaaatgagagagaaagcaacgagcagtgtttggctcaatgcaaatggttgcttttattattatcatagtaataaaacatttattaactgtctcttgagcacctactgtgtgccaggtactttgctaggtgctgaagatacgtagtgagcaagaaagataaaaatattggtcctcaggagcaggtgctctaggtggggggacacaggaatcagagaagtaactgcaaatgtcattagtgttacaacagttggggattatgatggcatcggaacctaacagaggggaggcttgcaggtctagggagttgcccagggatcggagcctgggctccagccctctatcctcaagcctgggcagttcacaaggttggacccctccatggcttcagagcaaacaaaaacagctaaaattgatggaatacatacagccaacaggcacactgtaaatactttacatgtattaacttacttagaatccttactacaaccctatggatactatttttatgctcattctagagatgagaaagtcaaggcacagagagattgagtaacttgctgaaggccacacagctagtaggtggcggaaccagaattcaaacccaggtattctgctacagatgccatacttataactacttcctttcatgactttcttctcctcttccctgcttatcagagccagtcctctgtctccctgtcctccccagacatgaggatgaccctctctggccccagctgcagcagaacatgcaaggattggaggacactctccaatcttcccctgtcccaggggctcctaaagtgtcctggttttgcccttggagcccaagtagaagaggggacgagggggagcaggagccagccaggtatacgctggtcccccgtctgcctgtccttcaggcataagaatctgggttactcctagagcccaagtgtccagattgattctaactccagcccctgaatgagccacaaactgagtcctaacccgggtcacactgaatcttgaccctggccgcacattccttcataaccctggtcctaggctaagccttgaccctggtcacacactgatccttaaccctagttgcatactgatccctgactctgatcacagactaactcctagtgtgatctatgacccaggtcatgtactgacctcagtctcagactgaaccctgatccttgtcaaggataagccctgaccctcatcacacactgagtcctgaccctgctcactggttgagctctgacgcaggacacagactgagctttgaccctggagagacactgagtcctggcactcctcactgactgatccctgatcctggccatagagtcaaccataatctggtcctagggtgaaccataatctttgtcacatattgatctctaaccctagtcatacactgagttcagccctggcctcagatgcccagccatctccaattgctgctgtctactgcccagggattcagagactcccagaatgccctcttcccacctttccccagagcttaaagtgattccactggcctgtgcagaggtcacccagcctgtcatccccggggcccatctgggggacctacagggctctaaaaaagacagggaaggcatgatttagacagagctaaattctcgagatgctgcttttcatctagaggctcccaaactcttcctatttctctctgtctcgtctcttcccccattcacacacatatttctcctgaaacaaaattcatcagcaaattctgtctttaagaagggaggtcagacagcagccagcccagcagctgggcagaattctattatcaggaggaaatgcagccagcaggaaggactgtgccctccctcccggcaaagtgttactcactctccccagcttggcttccttctgaagggctgtggagttcctgacaggtggaggtggtggacgtctgctgatgttgaccagggagcccgtgctcccaccggtggctggctgccccagacctggcccctgttctgggaatctgccccagtgtctgagcaacacaggggtgaagagtttgaaatggttccccaaggtgctttccaggattgcagggcctgggtagggccttacatattgggagagtccttgtggcctctttggggaaggatgtttcccccttaagacccctgaaaacaggggtgcaggatggatgaggaacacagggctcaccctccacccccatctccaggcagtgcaaacatgtgaaacatgaacacatgggcaggcgttgaggtttccactcagttccccctccctgctctggcagggaaaggacttttgctcctctgggccagggagccctggagggaggggagaggcatggttgctgaggctgggtgggggcttccagatgggtgtcacccatgcccttccgaccatctaggacagcctgggagttgtgtctagttaggagagtcaagagtcaagtatccagtgagctggtcattcggataccgaggtgggaaacaggtgatcagcctgacagtcatcttgtcagttagacgtagagacaggcagatgggcaggccgtcactcagccatttgatcaggcctgcagtcagacaagcaggctgacagacagacggtcagtcagtcagaggaggagatgaacagacaggcttcttcatctgttagtcagatacaatagatacccagcagacagacaggcagacagacagacatagacagacagacagacagacaggctgtccatcagccatcttgtcagtcagctatagagacagctagtcagtcagtcagacaggagatggacagctagtcttagttactcatctaattacagccagccaaacacccaggaagacagacagacagacactccaacaggcatttgaatgaggagatggagagaaaggcaatttgttttgcatctaattagtcaggtacaagagccgcagccaggtagacagggagagagtctctctgtctcagagagggacattcagtcagacatggaggcaggcaggcaggcaggcaggcaggcaggcacagccattcatccagtcagtcagctatcctgtctgtcaggctctcagacttgcggtggacaagtcagtcagtcagtgtccgtcagaaccaacctaccttctggccagtgatgcagctggccattatgacagacatccaggctgggcagagacaaacactggatgctatgaggaatgttaagaaatgggggtcctaagctcacagaataaccgggggtcccaacacccctctcaagagcctgatacagcccctcaacaatcagggaaagcattctggaagaggagggaagaggcaccccactccaagagccatccctcatctccctctgaagtgcctggcctccctctacaggccacaggcctagagaaggagctgtgtgtgtgtgtgtgtgtgcgtgtgtgtgtgtgtgtgtgtgtctcagctctgccaagttctcctcgcctccctcctccactggagtgggggttgggcggccctcccaggccacttcccattttgggaattgggctgagaactatgcaagagacagaaataattcctttttcgagcctggccagggctgtagcagcccaaacattggcacaaaaccagtgctggggaggggcccaggagggggcagccaggggtgggacggagccctggggcccagggacacaaaggcctgggtgtctccagaagaacctcctcatccagtcccagggctgggtacaggtacctggaagattcgagactcttagtggagctgccaggccagaaaatgttcgggattggggaggggaccaggttacagaaagaacaagaaagaagtcatagagtctccactggtaaagacaacttgaaaaatggaccatttctggtggccaagaagggatccctgctctctcctgagaacacatcccccgctatgggcagacccactgagcactcacataagagatggtggcctgggaagcacctagcacacagtaggtgcacactaaatgcaagtgtccttggaccagaatcgtacacaactagcttcgcagccctttggcactgcttcctagggtgtgaccctaggcaagtgacctcagctctctcagcctcacatttcccctctgtaaactgggagtaatggcaaaacccgcttcccggggtggctacgaggattaaatgacatgacaggtacagaaaatctagcacctagtaggtctgtgatctatttgagtccttcctcctttctttccttctttctcaaagcattattttcatctcactggggtcttacagcaatcagccaaggcagatcttgatcgtcattttccaagtgacaccctcctgaaatcagcccgtctcttagcctcagtgtcccccttgtgtaaaatgatagctcgggacaggagatgtctggaaagccctttcagagcctcagcgctagagtcgctggtgatcctcaatgcttgattgcatcattcccagcatgcaggggcccttcccaaccactccgtggggatccctgtggttctgaggaagctgaccctgccccctgccccagggataagccagtcagcacatggcatcccccagctagagagcttgctgagtggggcatgtgattcaagctaagccaatttattgacttctgagctttggccaggaatgctgggagttcccttctcttctggataacgtagagtgcatgtgtgacgcctagaaatgctgcagcctttgggactcccatgaggggagccagcccaagagaaaaattggctcacagaggaggacaaagcagagtaaatccttgacacaatgatgacatcatgatcccctccctacccttgctacacactgcctgggcttttcagttgcactatccaataaatgccctttattgtccatgccagtttcatttgactttcagtttcctgcacccaaatacaccccaaaagacccaaatacaccccaacagtctagacttattgccagttttaatcctcaatgtgactcttctacatagatactattgttcttcccattttagagatgaggaaactgaggctcagagagtgaagtgacttgtctgaaatctcacagccagaaactgtcagtgctgggatttgaacctggaaatgccttatgctcttctcaccatgttataagaccttctcttttctcatctatctctgggcaagtgggagggagtaaaacagtaacagccaccaccaaactccagtaataatcatcccagggaagaccaatcacataacatcaaagcctggaagacgcttagagatcattcagcacaaccctccatttcacaaatgaggagactgaggaccagagcggggaagagacacaggcagcaggaggcagattgggagccagagcctgggacagcaagaggacattgttcctgcaagggcagaggagtcacctgctgctcatacctggaggaagagggggcttctttttagcaacaaaccatctcaccctttgggggaactatcccttcccagctctcaagccacgtggcttgtagcctggcctcacctctggctccaggtctggccaatcagaacggtgcattcccctggcaacaacgattggcagagtctgggcatgtgaccccaatcaagccaatcagagtgaaccctgggacttgtcatgggactaccggaaagagaagctccagcattctaatggagctccgccttcagcacaggtaaggacaggctccaggctcagagctgccagttcgagtttaataacctagtttatttttgtggtattcatttttaaccctgtgttcaatttaaggtgattaactccatacagtttgccagaaccatctaggttttaaaactgaaagttcacaggtgaatggaggcaagggtggttggtcacccctgcttcaacttatgggtatcagatactggttttccattaatggcagcttccttttaaaataaacatttgaatttaaaaaggggccggacgcagtggctcacgcctgtaatcccagcactttgggaggccgaggcgggcagatcatttgaggccaggggtttgagaccagcctggccaacatggcgaaaccccatctctactaaaaatacaaaaattagccgggcgtggtggtgcacgcctgtaatcccggctattcgggaagctgaggcaggagaatcgcttgaacctgggaggcggaggttgcagtgaaccaagatcgtgcaactgcagtccagcctgggcgacagagcaagactccgcatcaaaataataatagtaaaaataaaacaaaataattttaaaaatttaaaaagagagtcacttgagggaaaataccaagaaactaatagtacctttggtgaaaagaaatggcaaaaatattgtgaatactgtgtcatgtgagtgagtgatggtgttgagaaatgtacaatgcctgcaagtctggaaacccaagctcagttcctgggttggtggcccactggccgtttgactctaaacaggttgcttgccctctccgagcctccacatcatcccaagctcacaaggccaaccatcctcagaggtggggagaggtcagagggcaggcaggctctgttgtgggcaggcaggctctgttcacccttatcctcttaagggtgaggtcttaaggtatgagttgctcccagtgcaaaagctggcaccaacagcagcaactcacaaatctttggagaggcccggcattccccactcagtgactgctgagtttgactgatggggccatgtcggcaaattagccaccattcagcagagacaccctttagagatgctaattgcccagtgctcatgcgtccccacccctccctggcacaggcggctggctgtcgatcccctgccattattgtctgataacagtgcttgatttgtctacacagaccagggcccctgcatgcatgctgttagcatctaactaccagccagcacggcgcatgaagcacggttcattaatgctcttgaggggagcaaacaggtgctggcagaaatctattcccgtggacaaatctgtggacacgtgcaccctcatacgtgcccacttagcccccaagtataggaatgagtcagtgtcacgtgtgcatatgcattctgtgaactactcatacgccggctaagaagcagcctcagacacatacgcacaggatggagtacatgcatgtacataacaggcaatgctacatggggttgtgttaggattacattacagaacacctgtaaggcgtcttgaacagcgcccggcatgtggttaattactcctcagtaaattagatctcttattattttttcccagtgctcctttatttattgaggtataacttacacataataaaatgcacaagttttaagtgtttagtgcagtgccttttgataaatagatacacttgtgtacccaccaactcagttaaggtccagaatatttccatcatccaggaagttctctcgggttcccttccagtcaatacctccaaaagcaatcactgttctgatttctcttgttatagttgaattttgcttgttcttgagcctcatataaatggaatcatatggtgtgtccttcttggcaatgcctattgtggatgctcagatgtgtgcacagccactcacacttacacacatgtgcatggatactcagtcagactcattcagaaatggggatttctgagctgtaaatcccttggcctcagcttgcagttcagctaagcctctctgggttcagaggactaaaggagatggggagagcccctgatgctgggtccagccaccgtggggggctccttccacattttcttcagcttcccttactgagtgacctcagacaagaactgaaaatctgttttctcctgtgaaatgaaatgaataataataacatacagctcataactcccctgtattgagcacttattatgcagtaggcactgttctaaggactgcgcaagttcgagtccactctgtcctcccagcaaccctataatccaggtatcatcattacctgtcttatgggaaaggaacctgaggcacagagaggcccagcagcttgtctgaggtcacacaggaaggggcagagctgcgatttggacccggtccagctccagagccttcacctgccaccattatccctctttatgaagggattatgagaattattgattatgtccatgccttggaacccagtaggtgctaaataagtattgcataagattactaccaagaacatttacatccactatctcactgatgcctcagaacagccccattttacagatgaggaaactgaggctcagaagtcagtggcaaaagattctggtcttctggttctaaatcccacattctttctattcccccagctggggatattctattccacaaggcagatgctttgttttgtttgctgctatgtcctcagcacctagaagagtgcctggcacatacttgacactcaatacatgttttccaatgaatgagtacagcagggagttgggaggaatcacccagcccaatgccctcccgttacagctgggggacccaagacctatagagaggatgtgactcatccaaggtcacacagcatcttggtgccgttgaagctattgttttctcccttgcctggctcacctcctctacccttgggcctgagcaagccaaaagatttgggagcccctgaggctctctcaaaggccacgttaatggggagctggcatggagcctctcccaacttcattaagccatccaaggtcagcacggaagcctgccaagctaaccctcagaaaacgccggctgaaaggaaacaaggcttgccagagcttttgcgctgggatggggaccattcctggcaaacaaggtggggagggaggaccgggccagcctttcaaagcccttcgtgaacaaatgcttggactgcagcctgctctggtcattgtcccctccaagtcagcagaaacagccaaactcttcagtctagcagggaaaatggagaatggactggagtctgtgtgtgtggggacagtgccaatgagagcccaccctgaagatggaagggaaaaggcaggaagatggtgaagctaggtagggggagaccatcccatcctgagggtaactcttagttgccagtccccagcccttgggcatggaggtcagttttaaataacactgattggccgggcacggtggctcacgcctgtaatcccagcactttgggaagcaaaggccagcggatcacgaggtcaggagatcgagaccatcttggctaacatggcgaaaccccgtctctactaaaaatacaaaaaaattagccaggtgtggtggcgggcgcctgtagtcccagctgcttgggaggctgaagcaggagaatggcgagaacctgggaggcggagcttgcagtgagccaagactgcaccactgcactccagcctgggagacagcaagactccgtctcaaaaaaaaaaaaaaaaaaaaaaaaataacaccgatcacctcccttcatgtcagggcatccctaaaagcagagcctgagacagggattcttaggcacgtgattcattcttgctccacgtctcctttaggagatgggggagagagagaagcaggacaggatagggaaggagctaagccaggatgtagcctcagctgaggtctagcttcggcctgaattgcaccaggtgttgatcccaccttgcagaaagagggctgagcttttgtacccctgactcaatgagtccacagtctgcctggtgggaggacgggagagctgccacaggttaaaatcccctggcaggcgactcccatgggccaagggcaattgtgagaggcaggagtcgtgagaagggggcagtggtgaactgttagcagcggggaatgccagcagttggggtgtgggtgcaccagctcgtaaatggagtgtaggtgaggaactcacagtgtccaccacactggctgtcctcttttcttttaaatttaaaatgtgtgtattttttatttttgtgggtacttagtaggggtatctatggggtacatgaaatgttttgatccaggcatgcaatgcctcataatcgtatgatggaggacggggtatccatcccctgaaacatttacctttgtgttataaacaatccaattacactcttttagttattttaaaatgttgggtgtcctcttattgtattaattcatcactacctaaacctcccaaacttagggtcaacccttagaagaaaagggagactgaattgaaccaagatacagtttccaccaccctccatcacggccattgcatccagtgtacgaacaaaacaacagccctgctcacacatctaggctcacagcatgcaagctgtgcctattccagttgtaggactctagaaccttcaagacactgagggcagaacttcagaattgtagctttcaggctctctgagctaatgtacccacaaagggggcctccccaggggaagacagaatggggcctggctcgaggaccaggctgggcagatgaagttacaaggtgaggaaagacaaggtggcttgaccaggtctcacgggaggccccacgacagaccgtggagaggatggcgagacctgagattgtgagaaggtgtaggaaattaggtaccagtggagcagccttggggtaggtgaggacctggctgcagccctgaccccagctgcaaaacgacctggatgcttcggctctgagtagcgcttagagcagggccacacttcaacaccacccatgccaaactgaacccctttcacctgggtacagcactctacagtgagcaaacaatctaatagctcagcatctggaggtgggtgagttgggggctaaatttgacgcagggggaaactgaggcctagagaagtgcactaacttacttcactagcaaattctgatgaagcacctactctgtgccaggcactaattcaggtcctgagatacttcagtaaacaaaagagaaacccctgcccacatggagcacatattcaggtgggcgaggagggggttggggaaggaagtaattattgctgtggagaaaaagaatgaagcagggaagggagataagaaggcaggagggctgggcgcggtggctcacacctgtgatcccaacactttgggaggctgaggcaggcagatcacttgaggccaggagtttgagaccagcctggccaacatggcaaaaccccatctctactaaaagtacaaaaaaatcagccagaatgtggtggtgcttgcctgtaatcccagctactcgggaggctgaggcacgagaaaattgcttgaacccgggaggcggaggttgcagtgagccgagatggcaccactgcactccagcctgggcgacagagtgagacactgcctcaaaaaaaaaaaaaaggaaggctgggggtggaaactgccatttgaaaatagagggtcagggaaggtgtcacttcctaaagagaggatgcttgaataagaacttggaggtgagagaagtcgtgcagggaacagcgggaatagccgatgctaagctcccccaggtagatttgcaatgggagacggagagatgaggtcagagaggtcttgtaggggcaggtcctgcagggccatgaggactttgctgttacactgagtgatatgggagccactggaaggctttgagtgggaggtgacatgacctgacgtgggttctcacaggatccctctggctttcagggaagcgtgtgagtgtggatgcaggtgagcagcgagaaagtaactgtaatagtccaggtgagaaatgacagtggcttgctctaaagtagaatttttttttttttttttttttttttttttttttgtgagacagggtcttactctttcacccaggctggagcgtagtggtgcaatcatggattactgcagcctcaacctctggggcccaagtgatcctcccattttagcctctcaagtagctgggaccacaggcatgtgccaccatgcccggctaattttttgaaattattttttgtagagatggggtctcaatatgttacccaggctggtcttgaacccctgggctcaagtgatcctcctgcctcagcttcccaaagtgctgggattacaggcacaagccaccgtacctggtcctaaagtagagtttctcaacttcagcactatcatcatttgggctgaatgaatctttgttgtggggctgtcctgtgcactgtggatgtttagcggcatcccggcatctacccactaggtgccaatagtaccatcccacctggtatgataccaaaaatatctccagacaatgccaaatgctctctgaggggcaaaaatcaccccccgttgagaacttctggtctggagcaggagtcagccagctatggctcacgggccaaatgcaacctgccacctgcttgtacaacccgagagcaagctgagagcagatttcacatttttaaatggttccgttttaagtgattatgtaagtacctacagaatatcctcaattttgcctcttggcctgcaaacctcaaatatttactatctggccctttcaagaaaagcgtgccgactcttggtcaggagtgttcatgggggtgatgaaaaggggttggaggctgatacactttgaaagcagggccttgggatttatgcagaggtcccacacggagtgtgaacaaaggaggagtcatgagtagctcccaggtttttggcctctgtggctggaaagagatactgagatggggggaaatcggcaggagcgagttcgcagtgggaggacgtggggcttagttttggagatgttaagtttgaggaatgtcacatagacaggggaaggacaccagctttggagttaggcagggtcattgtctgaatcccagctctgccgtggactcactgcagaacctcaggtaaagaaggacttgcctctctgagcctcagtttcctcacctgcaaaaaggagggcatgtttcgtgtgggctggatctctggataaggggcttttatgatgaacactgaggcataggcaatatgcttttaaagtgttttgaggatcacctgcgtcagaatcagttgagatccttgttagggatgcagatcctgggctgcctctagagactttgattctgtggtctgggcgatggacccggaatctgaactgcctgggttttgagaactcctgacctagggcttgggtgtccaattaaagagcctgtggctgcctctcaagacttgcaggttcccaagtggaaatgtctttaaagatcacagagcccagcagcctacccccgttaggcaaatgagaaacccgaagaccagagaagccgagtgccttgcctgaggccacacagctgggaagcagcagagctgggtctgggatggttgatggataggtggaaaggtaacagctggttcaggtaacaagcaattggatccagacagtgcgggtaggatccaggtcagagttgaatttcattttgggaatcaaatccttctggacttgggagagagacatgtggtttcttcccatttgagagtgttaaatgactctcccagactcctgttcagctaatgctttggagaaacaggagcccattttctgtgacactctttggccagccaggccaccccagtctccaataagccccttcctgcagcccaatggacttgctgaacccttgtgggtagcaatgtggggcacacaccaccagtattagttacattgaaatctggatttctcaaccttggctgcacagtggaatcaccttgcgagctttgaaaaacaccaatccctgggtcccatccccagagatcccgatttcacaggtctggcgggtggtctggcattgggatttttcaaagatcctcagctgattctcatgtgcagccaagactggtttagctgcccagggacaagccatcagaatcacattgattcacagagtgagaaggtgctaccctttccaattgtcttcagacccccagactccctgaagtggaaagtcccagtatgaagccagtgacattttaacacctctctaacacacatcttcccttttaacccagagagtaggtatcaggcttcagcatctggctggaattttatgacatgatttatggcaaatggcaccagttcttcataatatcaaatttcctgttaaaacaactcgatttagtaaaattaatgacttaatctaaagaagactattaagcaaatcctatttcaggtatttcccctggacctaatggtggtctctgacccaaactggttccctcactcatgatcccttctggccacagggattggctcagagatgatcatgtggctcaagtctgtccagtcagaggcaatcttcatgggaagagtcaggaaaaaaatggccattttatctgctggccttcatgctgggagggtggaatctggaggcaatgtcagctgagagatgaggaatgactttccaaggccaccggcattagtggtggagcagggatttgaactaggcccacctgcccacaaaggtagtacaacttcccgctaaaccacatttctggtgaattccctgggattcttcattttatttctttccttttcttttttgttttttagacagagtcttgctctgttgcctaggctggagtacagtggccctatctcggctcactgcaagctcctcctcccgggttcacaccagtctcctgcctcagcctcccgagtagctgggattacaggcatccgccaccacgcccggctaattttttgtatttttagtagagacagggtttcaccttgttagccaggctagtctcaatctcctgacctcgtgatctgcccgcctcggcctcccaaagtgctgggattataggcgtgagccactgcctatagttccctcagaacttctgtttcctgggttttgagtcttcatacgtagggtttacttaagtaaaatgtaatggcaccccataaaatataacccaaataggtacctttgaaaagctgatagaagacactgtaatgatcattcaacacattctgggcactggagaaggtatttggccacttgtaaagaatttagtgccctgtgctttcagtggatgataagaaacttctggctggagttcgagctgaacatttcagaccatctcaccactcctcaaccaaaggaaggtgaattgtggtttctgccaactttgactaacctctgaattcatccatccattcatccagcaaaattttatggaagatttgcatggaggtaggcaaagtgctagatgcaggagagacatgcctatagcagacaaggtcctactactggggagatcacagcccagatggggaggcaggcgctaatcagatcgttgcttaaacctatgtgaaattacaactggaatggaggccacccaagagagacacagagaactttgaaaatccataactgggggatctgacctattgagagattaggaaaggcttgcaggaggaggtggcattctatctgggagctctagggtgaggaggcaaataactggatgaagaagagaggaagagcattcgaggcagagggaacagcatgtgcaaagactcaaggcaggaaggaatttataatagtaagtatgagatcagcatggctggacacggggaggcaggagatggtagtggaagatgaagtcagagagtgttaaatgactctggcctcatggagtcttataggccactgtgaggaaatttaccctctcctcccaacccgttctgcagcaaatcaaacagaaaactcccacctttccatccaccctcgcttatagcataaggatgtgaaaaaattccactgctcttacgatttttgcaatttgaaaaatagaacaacgcatccatacaattggggttgcttataacttggggagtttgagttacttaaggagaaaaggaagaagagcaaagagaaaggcaagaagactaagaataaaaggaagaagtaagtgaggagaaggctgtggggaggaaacggagtggacaggggagggggtgtagtggttcagggcctgggctctgggggtaacaactggggttcaaatgctaccctgccacctgttagctgcatccttgcatgtgttacttaacctctctgggactcagtttccacatctgtaaaatagggataataataataccttccttataggatgtcgtaagggttaaatgaggcgatgtgtgtaaaacgtggtatatgagtgttagctattttgccattgtcttcagaggctgggttgcaccctctaacctctgcagtgtcctgggggaagccatagacttagcctggacagctggacggtgagaggaaacagagaaccccattgtgatggggctagtatgggacaggctttggagaggcagctaagaaatcttcctgggagaccaaaattcctccctgctagagcgagaatgcctcatttctgggagaagaagcgagtttctgcatttttcttagtgatagggaaagggctctggctacctccctcataaagaacctccagttcagggaagatttatccccacagtgatgaacactggaacccaaaacagtgaccaaggggatctatggataaactcttgcaagaaataccagggcctatcatggagggaatgacatcacgttcagtaagttaggggtgggatgtttaggcagagccctgaagcatgagtaagggaggccaagggagccagggtaggggccataagatcatcctagtcagatggcagcatgtgcaaaggccctgagttgtgacccagcaccacgtgctgacgctctgagaaagctatctagtacagctaggagaaaaaaaggggcaagataacaggcatgtgttacgaaggtagggtggtagaccttccagggccttggtggccagaaaaagattttggaagttatcccgagagcaacaagaagccgtggagtgaccaatccctctccctcctgctgtttcccctcacccccatccacaaaatctggagacacagcgaacaggcttggaggtgggccatgcatggaatgatttgggaactcagaaaactctaatactgtctctgaaggggtaataatcatccatccattcattcattcatccactcaacaaatatttattacttgctctgtgtgaggcacagttttaggcactggggagtgagcagtaaaatttgaccaagttcctttctaatggagctgatactgtagtgaaatgagacagataagagccagataaacctataagataacacgtggcaaaagggctatgaaaaaaataaaggaaggccgagaaatggagcataaaggcagggacgggaggtgtgttacaatttccttgcgaacatgaccaagccaatccttcctgcccgcccttgttccactgagcactcattacttgcaccatcataaatacagtttaaagattattttttagctccctccaccccatgagcaataaacctccctctccagttggcaccaacagtacacttgtggtgaccgcagtgaccaacaaactgttgcacttccccacgttctgctgccagcccatctcccgggctggaaagccgcaagcccttggcactttcttctgccccttgcctgacagtgtttgcctttctttggatgatggagcagtgagatcatccaggtgccccccaggggcttggcagagctgcttacttggatctgctccaggtcagccaacaagatggatttaagggtggatttaaacagagttgacaacaggttccagggtctttggcaggggtggggtaagggggccacactttggtcaccttcctgaggatcctgtcgcccttatcagcacgacctgagtggatgggcatcagacacaataagagagagaggcctatgtatcaggaccccgctggataaatgggggtttggggatcttctgtgatttgcatttcttcaataactgctgccaggaagacggatgatgaagggttaaggacacacagaagagatgagactcccaatataacaagcagggaataagacttccaactccaaacaccagtcttctgaatgtgcctgccagaattctgatcatgaagactgccgaagtgttctgaccttgaacctcagaattccaaccccgtacattagttccaacctgggacatcagcattctgaccttgcccgctagagttttaattatgaagagcaactctctggccatggactccttggctccaatgatggattagaggattctgacctcagatggcagttgtctgatcttgaacttcagagttgtgaccttgaatgatgttgctccaatactggacacaacagcagcaatcttgagcaccagaatcccaatcctgggccccctaatctctactgaatctctcaatgcccaagctttccagcctgaaatagtagagctgacatgactccacaggatacaaagtttaattctacacaataagcttttccacaggcccacagcccctagaaataagccaaatgcttcgatgatgataatgatgatgatgatgatgatgatgatgataacaacacaaataatactggcttacatctgttacacatcaggcactttgctgtgcactttacatgtttcatcttatccatcctctgggtcaccccagggatcttattattcccattttacagattaggaacctgaggcctagagccagttcagtttgctgacgtgacatcgagagctttttctagccactgcagtagctgtttcttcctgccctggttggagattgggtttgggaagttgtaactcattagctaatcaatttacgatttgcctgagaatttccccgacttgtgttgccatccatcaggcatgaactgccttgatttttggagccaagtcccgccttggggggatagtcattcattcaacaaagatttgccacccgaggttgtgcttgatgccagaaataagaagagggaaggtgggatatgatggttgattttatgtgtgaatccgactgcgccatggggtggccagattaaacatttatttgtgtgtctgtgcaggtgtttctggatgagattagtatttcagtcggtggactcagaaaagtacctagccctgcccaatgtgaatggacatcatccaagcctctgagagcctgaatagaaaaaaaagaggcagaggacggagaaatttgccccttttgcttcctgcctgccttctgagctgggacatgggtcttctcctgcctttgcactgggatttataccatcggcttctctggttctcaggcattgggactcagaccaaattacatcaccagctttctcctgaatgttcagattgtggaacttctcagcctccttactcatgtgagccaactcctcagaataaatgtcttactgggaagctgggcatgggggctcacgcgtgtaacccagctattttggaggtcaaggcggaaggattgcttgaggccaggagttcgaggctgcagtgagctataattgtgccacagcattccagcctggatgacagagtgagacccggtctctcaaataaatgaataaataaacaaatctcttagtgattctgtttctctggagaaccttaattaatacaggggacctattgcttctgtcatccaagctctgtctctttcctcccttccaggtgggggcctcagaggcaagaaatgcacccccaacatttccagccacgtgaaggctctatgctccagaggtcaaaaattagagccacgagggctgcatatggttccaaacatattctgtttggcccactcaaattgttttcaattattttttttgagacaggaaaacaatggagcttcctgacatgtgacactgatgctgtttcactcaacaagcaaaaggtacctgcttcactcttcattttaaaatggaaattgaaaccataccgagatacccgcttccatctgttagagtgacaaaaaaatcagaaagttcacaatacatggtgctgatgaagttgtggggaaacaggcaccctcacacatcgttggtgggagaataaattggtacaacctctacaaagtgcagtttggtcatatggatcaaaatgtaaaatgcacaaatctgttataaaatctgacttccagagatttctcccacagatatactcacagacacacacacacacacacacagatgttaagtgcaaagacagtcaccacagtattggagtttttgttgttgttgttgttgttgttgttttgagacggtgtcacgctctgtcacccaggctggagtgcagtggcgcgatctcggctcactgcaagctccgcctcctgggttcacgccattctcctgcctcagcctcccgagtagctgggactacaggcgcctgccaccacacccggctaattttttttttttttgtatttttagtagacacggggtttcactgtgttagccaggatggtttcgatctcctgacctcgtgatcagcccgcctcagccacccaaagtgctaggattacaggcgtgagccaccgcacccggccttttgttgttgttttgagacagggtcttgctctgtcacccagactggattgccgtagtacaatcatggctcactgcagccttgactccctgggctcaagcaatccccccacctcagtttcctgagtagctgggaccacaggcacatgccaccacacctggctactttttgtagagatggggtctcactaagttgcccaggctggtctcaaactcctgggctcaagggatcctcccaccttggcctccgtaagtgctgggattacaggaatgagacactgcacttgggcatgtttttaacttttaaaatgatttgccaacgttgaaaaaccgggatagctcccatgaaaattaaaatttctggctaagtccagacccagtctggagctgaatggctgctgccttctcaggcaggcttctgctccagttcaccactagccccctccactccctgcctgaaaagtggctggccatggaataggcatgttaggctgggtgttgaccagtgtcctccttgaacttgccctcctacagttcttccagcaactgcttcactgggtgacaaggcctacctagctccggtagccatcagagtctgaggccccggctcttgcctaggcagggaggttaaggccttctcctcctaacccataaggacctctgagtcattctgccctgcgggcagagctggcttcaagggtgtgcaacctgcacagttgcacagggccctgcgctcacaagggctccatgctcggtttgctactctgctatcaccatctcaaaattctttcttacttttgaacaaggggactgcatttttatattgtacggcaccccacgaattctgtagctggccctgccagtaggtcacttggtaattagggacacccagtcccccatacaccctgcccccaaggactgctctcatccatctagaaaaccacctctttggattggccagttctcccaggcatgaggccagcaagggtcccaaatttttatacaagaggggcttggggacagtaacctggggtggggaggggaacaagaggacttttcttgggttgcatttgcatagagctttatgtaacatggaggacgctccatcaaagaatgggggagtgtgatggggcctgggggtgggaggtggaggaagtatctaacacttcctctccaaccattccttggcacagtcattgcatgaagggtttgagcaggcaagggtatcatcaggggcaggactaaagcaaggtcaggggtagactctcttgaggagaggaaggagagaaggaaaaacaacttaacacgaatgaagtacctgtgctcagcccagcacagtgctgggccctctggcacggttaagtacacctgtctttccagtagctttgcttggtaaagtcaccatgcccgttttccagccaaggaaatggaaactcagagagaagaagggtctgcccagggtctcattgctcatatgtggggagtatgaacccagacctccagagttccaaaccagagctctttccacctaccctgccagggagacggcacatgagaggaggaaaaacattggtgcagagaaagggaaagatgcctaccccaagtgggcataatctcaaaataaaccagagaaacatgttatgatgggaagactgtaaacattaccaagtccaaactggccattcaaggtcagggagggcctctctgaagaggtgacctatgagctgagatctgaagaaggagaaggggctggctgacactgcaagatatgaagccagaggcccagagaagttaagtgattcactcaaggtcacacagctagcttgcatcttccttcccaccaatccacccacaaacacccaataagcccctcctctgcaccaggccctgatgcaacttcagaacacaggtcagcaaactttttctataaaggtttagataataaatgcgttttaggctttatggccatacatccaaaagcagctgtacatggcaggtgaatgaataggcctgcctgtgttccattaaaaccgtatttacaaaacaggcagcccacccaccctgttttgagcacagaagtgagtaagatacagtcttagactttgagaacatcctgttttatgtggagagatgaaacaagttaagaagaaaatagaatacgagagagagcacactgaacagtgcaggataagcggaatggcgatcttataggagaaagatcactcctgtagctcagcagggcagacatcaagttcaggctctcagaaaagtgcacgctctcagaaaagttcacatacactgagaagttttctttgaccttgccccattaatctctgtcaaaacaccttgtttctctccttccaacatacatattacacttagtgtgattattctttcatttaatttttaatttgtttaatgcgtatctccctccagtaggttataaactctatgatggccatggattatttctgccggtttacatttattctccccactcttggtaagaggacttcaatttttctttgggaaagcacctctttcccattctcaatcccatcccagctccagccattgacatgtgacccagacgcagctatgtgattggctcagggctgggccaatgaaaatcagccctgggattttgctgggcctattggaaaagagacttgctttgccccaggaagaaagcctggatttgagggggccatctttcctgccatgttggtgcagcctgctgagaagccatgacaaagaagaatagagcttagagatgtaggataccaagtcttgatgacatatttaagcccctggatccaaccttgctggaaaccttacccaacccaagacttttttttttttaacattttgcctaagtccattggagctacctttctgtcacctgcagctagaagaatcctaacaaatagatacacacgtgattttcaagcacccagcaggttgcctggcccacagtaacatgcactaaattgtttatcagacaaaccacaggcaggattgaaacaggtcctcaaagcatgcacatactcccacctaaacttagaaggaccagagaagcctagaatggaagccaccttgaaacagaaagaatgatctagaaacaggaggaatgactgagtcgaattacagtcactatttcaagaaacaataaaggttgtgcaaatgtatccactgaaaagagataaaagaaactcgatccattcacagagacagtgggaattccagacaagtgataagcaaaggaaaggctggttctgccttgtcttgtctccatctttccttttgcctctcatatgcccctgacagggcaatcatcggctgcctcttcggtacaactgagtctacaaagactctgagaggtggggctggccaagctcaagggctccaaggatcacacaaagcttagaaagactcagggatggcctgtagggagtgattagtgacaattgatgatctgtttttagaaactgtttggttctaggcccattacctggtggatgtaagtgatggtgtggaattggcaaatgcaatattattctctcaaagacagtgcctgcctgccagcccatggtgggcagttgtggtagaaaccagtctcatttcagagcaaaaatggagcagctgccaggtgcagtggctcatacctgtaatcccaacactttgggaggccaaggtgagaggattgctgaagcccaggagtttgaaactggcctgggtaacataggaagaccctgtctctacaaaaaaagagtacaaaaattagccgggtgtggcggtggtgcacacttgtagtcccagctactcaaggggctgaggtgggaggatcatttgagcccaggaggtcaaggttacagtgagccatgatcgcgccactgcattccagcctgggcaatagagcgagaccttgtctcaaaaacagtcagggtgtgagggaacacctcaagtgtctaacttaattgtgtgtctcctctctgtaaatggaaggcaaaaggccacttctttctgcaggcaggtagagacaagaaaggtggaaggagcagggtgtacctggaagagacccttaccttttaaggaagacccctctgatcagtcatcacaagatcatgcacatttgctcatttattcactcaacaaacgtttaccaacacctacctgcagtaacaatagtaatagtgaaatatactgaacacctgctgagtgccaggcacggcttgagtgtttcatatagaatttgcccaacaaccctggttgttatgaggctttccaaattacggatcaggacattgaaacctagagaagttatgtaattccccaaagggcacacagctcaaaagtggctgagctgggatttgaacccaggcagtcaggctgcacagcctgcacgcttaagctttcctgtttctctgtaggccaggcctggcatccacagaacaacccacaagtgaattttcacgatgttttgtgcgaggaaggtatgaacgtcaggtttccggtgcacagaggagggagcagtcagtgctgcctgaagggaagtgtaggtggtggtaggggggcggggggtggttaaagaaggcttcacagaggaggtggtggggaagctgggccttgaaggtggaaagagagaggctgcaggcagagaagaggaagaaatgggtgcaaggcagaggaacagcttgggcaagagggtgaccagcgctgaggaaggctggagcttttgggggcatgcagaaaggttagtgtggtggtcgcagagggtgtctgaagaagggatggggaggagatgaaggtggagagttgggttgggatgtcgaaagccaggctaaggagtgtggactatcctgggggcagtgggaactatggaagttttgggaagggggtgatgaagttgagcagactgcatttgagaaagtcggctctggctgctctgcagaggttgaactggatgggaaaggctggaagcagggagcctattctggggctcagaggctcccaggaagggtcagagttcagcagtgacccacaaggtcgcacctctgatctcacctccttctactctcttgcctccggtacactctgctccaaccacattaatacctgaatgttccttgagtgccccaggcacgttcctgtcccagggccttagcactgcttttctctccacccagagcactcttcccccacatgcccacatgcctgtctccctccctttctacttggcaccttctcctttcctgaccagcctggttaagccccagcactcccctccttccctgcagaactttctccacagtgccatccaaaatattatatcaggccgggcacggtggctcacgcctgtaatcccagcactttgggaggccaaggtgggtagatcacttgaggtcaggagtttgagaccagcctggccaacatggtgaaatcccatctctattaaaaatacaaaaaattagctgggcatggtggcgggtgcctgtaatcccagctacctgggaggctgacgcaggggaattgcttgaacctgggaggcagaggttgcagtgagccgagattgagccactgcactccagcctgggcgacagagcaagactctgtctcaaaaaaaaaaaaaaactacataattatttgatcttgtcatttcgtccataaacacttcagtatgtgtatctaaaagataaagattttaaaacatagtcgtaatagcattatcacatctaaaaacacagcattcattcctcaatatcatccaatattcagttagcattcatctttctttccctgattgtcttacagtctcatgatttattttgcatggttgttttggtccaatcagtatctgtgtttatttttttaacagtcttgctccttcttctactggaatatcagtgccatgagagctgggatctttgttttgatctctgctttgtccccagcacccagcacaatgcttgacacatagtaggtgctcaataagttccactgaatgaatatacacaaccaatcctgataataaaagtttgttattgacctgttgggcattatgtgtctgttactgttatttgccataattatcaaatccttacaatctccttatgaggtacgtgctgtgattaggtccattttacagatgaggaaacagctacgtgacccaaggactcacagcttaaaaaaaggctagggcttaagacccattgcacagcctgagggtctgtgaccactggtggaggcaggggcgttgtggcttcccaggagctgcctccacaccttacatccagagtccagccacttttcaccgatcttccctgccaccaccctcttctgggctgtcatctttcttctctttcctggaataatgcaatatcctcctggcagcggcttatcccttctttctctaatgtccattctccactgctaaacatcctccaatgcacaggacagccccacggcaaagaattctccatcgccaaatgtcagtagcactaaggttgagaaactgggctctggttgaaaaaccagacacattcttcatccagagcctggcataagcagctgagagtcagacttctagcaatgtgttagtaataagagtgaaagtcccaaagtttgtaaacaaattcctttttcatcaattagtattctcagttatctctaggataacatcattcattcatttattcaatgcatgtatttcatgcctgctctatggcaggcactgaagacacaacagtggacaaagcacacaaaatccctgccctttgaagcttacatcaaagtgggagagagagaaaggaatcatataattaagtaattatatgtcaggttgaaacaaataaagcagccatggggaatgaacagtgctattttatatgtggtggtcaaggatggccttgctgagatgacatttgagctgagacttgaacaatgtgaggggtgagtctcgtggcatcagcaggaagaccgtaccaggcagaagggacggacagtaagtgcaaaagccctgaggtgggagggtgcctagaacagcaaggaggccactgtggatgcaacagagtgatggagagggagagtggtagggaaggaggctgtaagggtgctgggaaaaggggaaagatgccagataatgggccctgtgagtgggactgaggagttgggctttttctcggagtgaggcaggagccataggagggttttgagcgggggcgtgagttgctgtgtgtggagaccagacgggggatgggaggctggaggcagcagatgggactagaggctcctgcaatggtacaggagggagaggatagggtcaggaaggcagcagtggggtggcaagaagtggccacaacctagacacgtcactcacacttgcatctcactctctcacttgcattctgccaagccgtcctgagtggaagaggaagggatgagccatgctgggtgtgtcagagattgccccttatcctggcaacaatgataacagcagctgccccagatggcgactccctctgttcccagcactgcacatggtgctccacagcttagcacctctgatctccgccatcccatgttgtcttctgtggctgggcttcctggccgtgtgcagaatcacccagggcaacaaatggtgtggggaaaatggggatatccccatgcaatggaatgaagttggttccttatcttacacaccacatgcaaagacctaaaataagactacaactgtcaaactctcagaaaaaatttggggaaaagctttatgatttccccctattgccaaagattcctcgaatataataccaaaacacaggcaacaaaagaaaaaacagacaactcggtcttcaacaaaatacaaaacttctgtgtattgaaggacacaatcaacagggtgcaaagacaacctatggaatggaagaaaatatttgcaaatcgtatatcttattagggattaatatccagaatatataaagaattcttacaactcaataacaacaacaacaacaaaaaccccaatttaaaaataggcaaagtacttgagtagacatttctccaaagaaaatacagtagtccccccttatcacagcaatatcactttccaaggttttagttacctgcagtcagctgtggtccaaaagtattacatactataagatattttgagaaagagagaccactttcacatagcttttattatagtattttgttgtaattattctattttattattagtttttgttgttaatctcttaccgtgcctaatttataaattaaactttatcataggtatgtatgtgtaggaaaaaacatataatatacagggtttggtactatccgaggtttaggcatcctgataagggggtgctagtatatacaaatggccaaaaaacacatgaaaagatgctcagcgtcactaaacatcagggaaatgcaaaccaagactgcaatgagataccacctcatgcccatttggatagctactaaaaaaaaaaacgtaaacaaaaaaatagcaagcattgacaaggatgttgatatagtggctatttgtcccctccaaatctcatgttgaaatgtgatccccaatgttggaagaggggcctgcctagtgggaggtctttgggtcatgggggtggatccctcacggatggcttgatgccctccttacggtaatgagttcttgtgagatctgcttgtttaaaaaggcctggcttctctcttgctccctctctcttcatgtgacacacgtgcttcccctttgccttctgcatgactgtaagcttcttgaggccccatcagaagcagatgccagcactatgcttctggtacagtctgcagaactgtgagccaaaataaaactctcttctttataaattacccagcttcaggtttttctctatagcaatgcaaaatggactaatacagataggaagaaattggaacccttgtacaccattggtgggaatgtaaaatggtaacagtcactatgaaaaacagagcagcagttcttcaaaaaattcaaaatagaattaccatatgattcagcaattccacttctgagtatatacccaaaagaattgttaaaaatctagttggtttctgcttatccatgcccagaagaattgaaagcatgaactctaagagatatctgtaccccatgtgaatagcagcattattcacaatagccaagaggctgaagcaaccaagtgtcttttgatggaggaatggataaacaaaatgtagtgtatacatacaatggaaaattattcagtctttaaaaggaaggaaattctgacacattacaacatggacgaagctgaaggacagcatgataagtgaaataagccagtcacaaaaggacaaatactgtatgattccacttatatgaggtacctagaacagttgagttcaaagggacagaaagtaggaagggggttgccagggcctaggaggtgggcccaggagaatttaatgggcacagagtttcagttttgcaaaatgaaaaagttctggagattggttggacaacaatgtgaatatactttactgaactatacattttaaaacggttaagatggaaaatttcatattatgtgtattttaccagaactaaaaagaaaccacttagggggtgagtttcaactgtggggcctaggcatgagtattttgcaaagcccaggtgatccttatgtgcaggcagcatggagaagcgctactctgtgaggtgtgccccaggtattacccccacctcccagtctcagagaggtgaggcgccttgggggctcatatagccaggaagcagaggaggtgggatttgaatccaggcctgtacccaggtccacagaagtgtgtctcacatggcaacattacatcttatttgttatttatgtcatcagagaaaacatttaaggagcattggcgccctggatattaacatgagaattctagctcccaccccacccactcccgatacgggggctgagagattcctcccatttctggccccacctagtcatgcccactcctgctggagacaccaaaatcaagttgatttcacctcagggagaaggtaggaccttatgcatttagtttatctattaaaataatgcttaatgctaaatctgtctctcccatagtcccatccaggagcctttgggggtaaagtcgtcctagatccagagctaagaacactcctaagtcatagggtgattctggacaaatctctctcctctcagcactgccccagcatgagaagggaatactgggatcttgcttctcactttctgaaggtcactcatacaactcagagatcaaagtcatgggctgggcagtcagggagtcctgggtgggatctgtcccagccttccattcactgtgtgaccctgggccagacacttcccctctctgagcctcagtttccacggctgtaagatgagggtagttatccctcccttatgggggggctgtgaaaatcagatgtgatggggcatttaatgccctttgcactatgccaggcaagcacattgtaagcactcagtgttagctgttgctgccaccactgtggttttcattttatctaagagacagagatgaggctgactgtgccctgccagacctagaatttcttcttttacgacaacctcctagaggttctctctatcgggggtgggctgtctataatacaacaccaggtcattctgaataaatgatatgtcctacagagctttggttggtttccccagaatctcagatcctaagacaaggttctgagtacaagtggcttatatgataagtgatcccagaaaactctggaagaggggagggaacatgagacagggataggaaagaggtcaaacagggtctgttatcaaacaagtaattgctgtgagcaactgaagctgccctggggaccagtgtagaacacacacctctgagttatacccccagccaggggagaagcacgtacacatcgtccccatcagccggcaggtgagtatcccactagttcctgctggggtgttagtgccctgcctttactggactccagtggccagagaaagcctctaaccttacaatgagcaggtatcatttgatgagagcagttttttgaaaaggagcttatttatcttgcaggattgtcaggaggattacatgagaggacagtaaaaaagaaaaaaaacaacaacagcaaaacccaacagttattgagagctttctacataccaggtcctagtctaagtgctttgcatacattaatgcatgtaactcaatccaatgaggcaggcacagtgattggcccaaaattgctgttggctgaaggaaccagggcacagagggctgcaatagttgaccccaaatcacatggttagtgagtagagaagccaaactctgaacttgggcaatccagtgctaaggtcaagtgcttcccatcctgatgacattatcaagtacaggaagtacacaaagtgctgggtatggagttggtgcctaacgcatgcttgttctcttctagttagttaagctttggccaacccattcatttgaccatctctttttcttcctagcatttcacattcacacagcaagtcggtgaaagatcaggggccatgcccaggcctttctggccccgccacccgtacccgctgaggctcagggatctttctgttactccaggatgtttgaccaggatcatctcttagcagctggtctctcaggggatttgaaaggctatgatgggctgtgtgatcctcagcaggtcactggagcatcctgggtctctgggtttctttatcctgtggggatgtgggatttctcaggcacagcttcaactctgatcatgtgctatcatccttcatccttcagacaaccctgtggagtaggttttattatcgccctcacttacagattaggaaatggaagtgatgagaggtgaagcaaattggccaaagtccacagctaggacaaggctgggctgcgattcgaagccaggtctgtgtgaccccacaatcaggattcagaattgctggcatattatctgccaggataaaaacaggcatctggtttgaccaagctggggccagcaagagcctaagtcgatgactcatcacactgaaggggccccatagattctgagttggttcccgcatttcttttgatgataatacacagatccttgtggctcaggtcaaggaagctggaacctcattacactagagacgtgtagctggagcagaggaattccgtgaaaacactaacaatcgttgctgccacttactgaatgcttcccatgagtcaggcgctgggctaggctctttacattaggggcatctcctaacagctcttcatggttgcctctgttataattctcatttcctagataaggaaagtgacactcagagaaggaaaggggcttgcccaaggtcatattcatggtaagcaatggagacaagaaatcaaccgcatctgttggactccagagctgattcttaatcaagtctgtgatgggaaaaatattgaccactgttcctaaagaaaggccactctaagctgggcatgatggctgtcacctttaatcccagtgctttgagaagcttagatgggaggatcacttgaacccaggagttcgagaccagccagcacaatgtagcaaaaccctgtctccacaaaaaaaaatttctaatgtagccaggagtgatggtgtgcacctgtagtcccagctactcaggaggctgaggcaggaggatcacttgagcccaggagtttgaggttacagtgagctctgattgcaccactgcactccagcctgggtgacagagcaagaccctgtctctgaaaaaagttaaaaaattaaaaataaataaataaaggccactcccacttttgaatacaataatacttcatacttataaagtactttccatttacaaattacattcacatctgaaatctcattgaatcatcaaaagagccctgaaagggagctatgactattatcaccatcaggcagatgaattcactggacctgagagctaaaatgatccacccaaggtcccaggatttagaaacataggcttgggaaccagacaaacttgggttcaaaccttggctctgcaattttcattcctttgataaatatttactgagaacctagctgtgtgggctcaggcaagtgacttcgcctctcagagcctccatttcctgttctgtaaaagagtcttcataccacttatcagatccattccctctctcatctgaaaatgccagacacttgctttctcaggttccctcagagctagagcatgagcatgtgacctgtcctggccaatgggattttaaaagaagtctgctagggtgctcctgggaaagggtttcctctcagaaaaaaaaagaaagtgggccaggcgctgtggctcacacctgtaatcccatcactatgggaggccaaggcgggcagatcacttaaggtcagacatttgagaccagcctggccaacatggtgaaactctgtctctactaaaaaccccaaaattacctaggcattgtggtacatgcctgtaatcccagctactcggcaggaggctgaggcaggagaattgcttgaacccaggaggcggaggttgcagtgagctgccgagatcatgccactgcactccagcctgggcgacagagcaagactccatttcaaaaacaaaagaaagaaagtggagcataggagaaaatgtttctcttcacggattaaacatcactgaatgtacgtctgagggctggaactgggcagccatcttgtgatatgaagcatcaagcatgaggaccaagccacttgcaggggttggggagcagaggagcagagagatgaaaagaatctagaatcctggtggcatcattgagccattaactcaacctaaaaccaactgccttggaacttcatattatattcaatgatgcatcttcctccttattgaagctactttgagttttctattctgctgcttgcagcccaaagcatccctaactggcatactacctggttgtatccctgttggaggaatttcaatgagatagcagatatgaagcaccactaatcagtgctgggcacaacaaacataagctaccctggaaattaggaagttatctcagggctttaatcctgagactatcccagggatcacagacactcctgggctggcaaatcagttccctgtctctcctactgagaaaagcctgtcgagttttccgagaaagccaaagccccgtggtagccccagcaccgcaaccctgtcacaccaatggggctgtccccatcttctaaacaagaatcaatcacactgccttttgcctaatgggttttgattttcgctcccctgatggcaaagcctagggcctgtgctttggtttgtctccgagttgccagaacatcccatcaattattaacagtgtcagctcagtctccctggccctgctgctctcagaaggaaagggtttgcagcaactcggcccacccagccctagaaaaaagactcttttccttagcatttataacaacaatccccacctgctatgtgctaggctttgagcaaaattttgacaaatgtgatttaatgaagaccctgtaaggtgagccttttatctccattttacaggtggaaggttgggacttggaaagttggagaaattagctaaaagctatggaagtggggagtggcacagaaccagatccatccttgctcttcagcatatgagatatggccacttttgtatcttacaatcacctagaaatgatcctccatttggtcctgtcactctgtgagttctaagcaatttccacaggctttgcttgttttgacaagcaaggcatccaagctggggggatgggtggggatgggatgggcaaggtgcagatgactcaaaggaggccagaggcacagggacctgggttgcaggtgggcagtgagaaggggtgacaggtccccaaaccctgagacacagtgactgactgcttgcttgcttgcttgattcattcattcgttcattcattcattcgttcattcattcatttattcattccacatgctcctcagtgccaggcaccatcatgggtgctgggaatcaagcagtgaatcaactcatggtactcacattcttgtgggtgtgaaacagagacacacaaagaaggaaatataatttcagatggcgtttaaggcctctgcaggaaaggcattgcatgatgcaacagagagtgaggggagggaaactgtttagaacagcggtcaaggaaggtctgtatgaggaggggacatgtgagcagggacctgctcaaatgaggaagggggagaaggggctggccaagggggaatctggggaagagcattccaggcagcggaaacagcaagtgcaagggtcctgaggtcagataaactctggcctgtttatggaacagcaaggccagtggggctggagccaagtgaaccagaggagatcaaaagagatgagcccagagaggtcatgggggccagattctgcctgggccttgtatgccaggatgaaaagtctgaattttattttgagtgtgatgggaaacttctggaggattttaagcagatgaataatgtgatccaatttacattttgaaaagctcactttggctgctatgtggggaatggattgcaggggcaaaagtggaagccgggagactggggaggaggctgcggcacttgatcattatagaaagaacactcggtttggatttctggctactcctgactgcctgtggtgtgaccttaggcaagttacttaacctctttcagcctcactgtttgcgaaaggtgggataataacagagctgcgttgttacactccatacacagtaggtgtttgatcattggcagccaggatttctattctgagggccagtgagcctgcctccctccccatttcagctctggctacagaaaatcctagatggtccatctgccaggaatgtgagctggcagccccagactgggatcatggagaggtcacaaggctgtccctgctagcggattaacccaagggagaggagaggttctttattcccaaacagcacctcttgcaagccccggtgcttgggtcttgctgccagaccaaaacatggccctgtgcctgcttcttctctgggagggcaaattgtccagttccctgtaccttgttctcatgtcttagggatgggacagggagggagagtcacatttgggcctaaatgggatgtgcagtgggagaacctgtgtcatgcctggaaatagcaaaataagtctgttgatcctaagctgattaagggtgagtgactctgtcttaggaggaggctttttggacacaaaattgggggcgggattatggagagagacagcccacagcctcagaggaggaagccaggcccaggagcctctacatccttgttagggccaacagggaaacgaaaaaaacacgtgggggctccctccaccctcttaccagccaccccttctccatccactctcaggggcctctccttgggtggctagatctggaggaaggaccccacggagtctcccttcagactgggacctgcaggtgggccttcagtgagaactgagccggagaccccacaatgaaaggctgggctggacaggagtcagccctagctagtaagatatggctggatatttaggcttcctcctctcctctttcttttaccacaaatctacttacctgacccctttttttaggccccacactcagttacattctccccatgtttcccaagttggtcttgctggatttcaacatcaacatctctcttttctgggttctccgtgaacctcacagaacctcttttatagccttgcacacactgttttgtcatttgctcccagcacccagcacttcgggcacatgaagacaggccccatctttcccaggcaaccccaaatcccagcctgacgtagagaagttgctgatcaaccagtgccctcctgccctgccttggctcccaccccaagccttcctcagtcccctacagcccctgccattacccagcagcaccaaagactctctggcccactctttgtgttcaaactcattcctgcctcctcctcctcctcctcctttatttttcacattgcctcatttttcgctcctattttgaaatttacatcttgttccaagagctgaaacatctttacaagctgcaccaaaccattctggaaataaactcaccaaataaataagtaaccagggggtgacccctcacccgcaagcatccacaaccaactgcatgtgtcgtgtgggtccacacccacccctcggggtcccttcttacttatgtttaaactatctgacagtatctcaatgtcctgtaagcatgtctgtaagctgcttttttcccttgctggggcagagtgaggttataaatatggagatattaaaatcacagggtgatccaatccagcctaggtctgggacttcacagggaagcaaaccctactccaccccagcaagccactgttgtctctctgtgctctctctcttattcgtcagtgtccatcttcttgctgtggctttttatgggtccctgtgaaacctctccaaccaagtaggggtataacgtcttggataataaaaagatggagtgaccagtgccacatgggaaaagtctgagggggttggtcctcacctctggggactcagtcctagcccctccccattactaatcttcatcgttgggaacaaagccagagtcctccagcagtggtcctcaatatggggatgcaagcagatccccccagaccagcagcccccagatcccagactcaccttggcagccacagaggaattgggcttctccagtaggtcccagagttttttcctcttctctgcgcagcacgtgttatcgaactcctcgccttcccgctcccgtagggtctcggcctcacgcttgagctcctcgttcatctgctctttcttctggtggtagcgggcctggcagcaggactccaggtagatctcgtcgatgccccagtagtcgagctcttggctgaagctgagcgcgcacatctcctccatcatgtgcagtcgcccagtgcggtagaagttgaggatggaggtgaaggcgcccgggtggcggtcaaagaagtactcgttgtcgtcgaggctgtagtcatcgcacacctcgagcagcgagtcgtgcgtgttgcagtcgcggagcttgcccagccgcgtgcggggcaggcggtccagggtacgccagagtacctcgtgcgccagccccccgacgttgaggcggacccgccgagagcacgccttgctgcgcacgatctccatgggctcgggcggcagcgagctggtggagcgggagccatgcttcgtcatgcccgccggcatcgctgatccggccgcccccgccccccctgcccccccaggccgctgtcactcgacggcaaggcccgctgctgcgggggaggggggcagggagcgctgtgggctgctgggggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctccaccaggctcccagccggccttgaccttcccccgcgcttaagcggctcagtggggtaggacggatggtcgctgtccctcccgccggtgctgaagtccgccgcaccccatggatggagggaggggccgcccctcggggcggggagagggccccaagagatgcccctggagcccgggaggccccaccctgggcttctgcggcccaggcgcgacccagccgcccggggcgctgtccgccccttagagtgctgaaactctcttcattatgggtctcccgatcgagtcccgaacctggccccgccatggggagagagggggagctgcatgaaaactttctttctttatctttttctttctttcttcttcttctttccttcttttttttttttttaacgagttctcttcttttccttccccttctcgagataatcaagattttgggggtgggggaatggcagcgggcttttttccaaatcttaaaagatttgggggaattccgggggttccaggtgcccacctgtccgaggtcacaacagacggggtgtgcacaacagcccctctgtcctggagcgacccctcttcccaaacactggagcatctcctgagattgctccagcgacaaggtgagccgcgaggaggaaaagcccgctctcgcctctccctctgagcccccaaccctaccgcaggaggggcgggcagagtcctcgggatccgcctgctccgtcctcccctcgctccttccccgcccccttctcctccttctcctccccctcctcttccttctccccctcctcctcctcttcctcctcctcctcctcctcctcctactcctcctcctcgttcctctcccgcgatggctttttataactccgggttctgcgcctttccccgggcttggaagggaaggggtgggggaggtgggaggcggggaaatgagctaaattttctggccttttcaaaaggtgccatcctcctaccgcgcactagtgatttcggggggttcccctgagcaccccctgcatgtagggctcacgccttagccccagaatggggattgcgcgtcccctcaggcctcagcccttgcctgcctcccaccccgctcccctccagcctggagctgcggagcccgagcagaccaacaggccgagctgcggcaggcaaaccccctgtccgtgtccccatgcacccccacggaaggccgtacgccccaacactcacccccagggcggccgcctcctggggccagggaccgcgcatcgtcccggccgcccgggcgcccccgcccgtgggcagcggcggtcccggggccgggctgagccgggcctaccccggccgggcaggcaactcgcccgggctgcaggcgccgcggggccggggcgcgctctccgaggcggggggcgccggcgggcgccgggggcgcgggggcaggaccgcggccgcgcggcacctcctccacctcctcctcctcctgctcccgcggcggcggcggcggcggctgcctgggcgagatcaacaagtcggggctgagcttcggctccgcgctcgctgctattctgtcccgcacttcggagcgcccggagccgggcaccaaggcaggacggcgccacctgcgggtcggaagcgagcgcggcttaactcctgcctgcccggcccagcctgccggggaggccgggggcgggctccgggatcgggccaaggagacgcgcgtggccgtgcatccctctccacccaggccacctgcacagctggcctcgcgatcccgccttccttcgtcccgtcaacaacgtgtgttgaacgcctcctgtgcgcgagccgcggtgcagggcacggtgacaggcgtctgagatacagctgtgaatcaaacacaaacatccggccctcgtggagctggttggaaacagatcataaacaaaaaagcgaaaggatatatgaggcggtgacaagcgctgggggaaataatgaaacaggaggaagggtcagagggtgggagggggcagatcggaactgtaaatagcccttgctttcatgagcttccattctagattttagcggggggtcgggggtgggggacggaggcggacaatgaatacatcagtacatatgcaatgtggcaggtggtgataaccgctaagaagaaaaataaagcgaggtatggggaagagagggtgaagagtgagctggtttatatagtctggtgattcattcattcattcattcattcatttattcatgttaagttggacatctggttattgacagcttcctatgtgcaagcagaatgccaggctccgtgaagggaaagtcttccccctggagctccccatccagtgggggaggcaaaacccatcacataatcccagaaatgaaaactggaggaggtacctggagaggcaggcaagggttctctaaggatgccacagatgggccttgtgtttactcatttattctttcaaatattcatttactgcatgataagtaaataggtgtcagcggccgggcacagtggctcatgcctgtaatctcagcactttgggagactgaggcgggaggatggcttgagcccaggagttggagaccagcctgggcaacatagtgagacccatctctgccaaaaaataaaaaattagctgggcatggtgctgcttacctgtggtctcagctactcaggaggctgaggcaggaggatcacttgagcccaggaggtcaaagccactataagctgtgattgcacctctgcatttcagcctggataacaaagtgagaccctgttgcaaaaaaaaaaaaagaaaaaaaaaagtgccggggatgggtacagcagtgagctcccctgccctggaggacaaaaactgaacaagatacagtgttccaacacaggttcctctctggcccttttcttcctttctaaaattaaggggttcatttccataatttccatagagttgcacataatattattatatattttttacttgtccacttatcatctccaccatcatgacccttgtccaaggtaccatcgtcttgtctccctgcaacctccctgcaacttggctcccatcttggcctcatccctggctcccatgcctggctcccatcttggcctcctacagttcattctccccatggccaccaaaacaactgctacatttcatggaccatgaaatgttggaccatgtttctcatctgcttaaaaccttcccaagactttcccttgctttagactaaaacctaaacttctggcctattgccctaattcagcccgcccccctttctgagcttgtagaccagtggaggaagacaggtaactaaaaaagtaaatttttaaagagagagtttcaggctacagtgattgttataaaggaaatggaacatcatgatggggtggaaaaagagagaccaagctgctagtgttacacagggtggtcaggaagggtgtctcagaggagattaatagagattgaaagataagaagggactagccatggggagaatgagggaaatgcattccaggtggaggaaacagcaagtgcaaatgacctggggtgtgagagacagtgaacaatcacattccctcctgcttcagtctggtgttcctagggtcagaaagggttctcagctggcccctctgtaagcctaatctgttgaaggcaacttttctccagagatctgggcattcccacaggaggtttcagaaagcaataaatccttcctgatgagagggaaaaaatgactctataatggtgaaatttccaggcattactgcaggcattacggtgccttccaggtacagctaaaataacacctagaagtgcggttcttctctactccatataaccaaggagtggagatgcatgtttgttgggcacctactacaagtagtcctctgaaggtataacatccatcagcttccacatctgtaaataagagatgaggttatttatagatgtggaagctaaagctccgagagaaggtgtcttgcccaatatcttgctggcaagtgctggcacaaccagatatgggaatctcttgtttgactccaaaatcaacgggctatccaaataccagagcagcctctctgcaaagtcctttctccatcagttcatttattgattaatggaatcattccagatgtttactgagcatctactgtgtgcctcagcatgggtgttggtgctgggaattgagggtgagtaatttatatggtccctgtcctcgtggagccacacacctctcttgccaaggccaggaacagacagaaaaccttgttacttgtttttcttctgtattgtttttttcatttttaaattcccttttatctgcattcccctcccactagcccataggaaatggttgtcatgtgtcaaccgtatattgttttgtttgggtttgtttttgcttttgcttttagagatcgggactcactctgtcatccaggttggagtgcagtggcatgatcatggctcattgcaacctaaaactcctgggctcaagtgaaccttctgcctcggcctcccaaaatgttgggattacaggtgtgagccactgcgcccggcctgtatattgctttgtttgtatgagttcttgaaaactgtgtttggtgttttgtgtgcactttaaaacttgcatatatggtttgtgttatacatcacattctatttatttttctctaagatccatccacgttgctgtgggtacacccagcctgctgcttgtaatagctgcacagttgttcacgatgacacaagtcccctttccactgtccacccgctatgtggtcacccagaagacctccaactcccaccaccacaatgaatgcatccacgagcatcctcccatgtgtctgcttatgagccagtgtgatgattttttaaaaaaacatttcctgcaggttcagaattgacacatcacagagtatgttgcacttaatttaactaagcacacccaagtctccctacagatgtctgttccaggctgcatctcaccagcagtgcttgagagttcctacagctccacatcccagccagcatttggtattatccagatatgtaggttttgacagtctaacacgtacaaggtaacatctcagtatatttaaatttgcatttctctgattactaatgagtctgagactctcttcatatgcttattgttctcttgtataaatatcacctgtgcacatagtggcccatttttctatcaggattcctgtttttttcttgatgatttgcaggattcctttgtataatgcagattttaagtcccttgtggattttagacattgcaaatatcttcttctgctttgtcacctacctgttaactttgcctatggtgtcctttattaagcagaaatctttttaaagtgatcaagataatctatttttggctgtatagtttgtgcttttaaagtttttgtttgagtcctcccctgcccctaagttgcaaacagttttgtttattaattttatatttttattttttactttaggtctttaaccaattgtgtgtgtgtgtgtgtgtgtgtgtgtgtgtgtgtgtgtgtgtgatttggtagggagccaacttcattcattccctatagctggctagttttctgaaaactacctatgaaataacttgtcctttccccagctgatctgtgggccacctttgtcatatgaagcctcttgcactccccactctgctccattgggcttcttgtgcttatgtcactgtggtcctgtttttattagcatggctttatagtgagctttagtgcctgtagcccttgtctctcttctttgttcttttttagggcacacttggctatttgtggacctttaatcctctctacaaactttttagtaagtttgttatgggacagtttctcttcccttgcactcatttcctaatcctgatcaccagtttgccaccaaagcctacccacagctcctctacccagtgaaacccctgaggaatgttgccatggttaatactaagtgtcaacttgattggactgaaggatgcaaagtattgctcctgggtgtgactgtgagggtgttgccaaaggagattaacaattgagtcagtggactgggagaagcagacccaccctcagtgtgggtgggcaccatccaatcaaccaccagtgtggctgaaatagagcaggcagaagaaggtgggagaagctgacttgctgagtcttctggcctccatctttcttccatgctagatgcttcctgccctggaacatcggactccaagttctttggcttttggactcttgggcttacaccagtggctctcaggtgtttgcccacagactgaagcctgcactgtaagctactctacgtttgaggttttgggacttggactgagccactactggcttccttcctcttcaatttgcagacagcctgttgtgggacttcaccttgtgattgcgtgagtcaattctccttaataaactccctttcatatatacctctatcctattagttctgtccccctgaggaaccctgactaatacaaatgtggacagacaggtccctggaaagaaacctggggccaatcttccaatcagctggaaagccaaggaaagcaatttccctacaaaaatgagtgagacaggtattttgatgttattatgtttgtttgtttgtttgttaaacaaacgggatatgttacaatgtctggagatatttttgactgtcataactccaggggagagggagagtggttgtcctggcatctagtgggtagaggccagggatggtgccaagcaccatgcatggcccaggacagccccaactgtaaagaattctcctgccccaaatctcaacagtggcaagattgtgaaaccctgcatgagttagatggaaggcaaaggtgtttcccagtctggaaatgccattcttcaaccaaccattaataaacacctactatgtaccaagcattactcttgacactggagctacagtgtaaataaaatagacagtactgcgctcacggacttatattcttgtgggagatacagttaataatcaagtaaataagtcattctgcttgtgataaacgcaatgaaaaaaagtaaatggaagcgatagagcctaactgagagagacatcagcaactttagatagagtagtcagggaaggcttcctggaggaggcaatatgtctaagctgagaacctgtgggtaggaaaagccaaccatgtgaagttctgaggaaggaggtacaggcaagggaacagcacaagcaagggtcctaaggtgggaatgagcttgatgtgttctaagaacagatggatgccaagaccaagccatgcattgcccggttgggattttattctcaaggttaagggaggagtttgagttttttctaattgtgatgggaagccatggtagtgttttaagcaaagaagtcccatgcactgatatgttttgaggcgatggctccagctgctggtgtgcactatgaagtatttgaggataaaaaatggcggcaggaaaacccacgataagatttctccaattgtccagggcaaaggtaatgagatttggactcgatgatagtggcaaggatggctgggcagtttcacagccacaagtctctgatgggagactggtatctagtgggtgggggccggggatgctgctaaaccccatgcaatgctcggcacagccccccactataaagaattcttggccaggcatggtggctcatgcctgcaatcccagcactttgggaggctgaggtgggcaggtcatctgaggtcaggagtttgagactaacctggccaacatggtgaaaccctgtctctactaaaaatacaaatagccaggtgtggtggcgcatgcctgtagtcccagctattcaggaggctgaggcaggagaattccttgaacctgggaagtggaggctgcagtgaaccaagattgcgccactgcactccagtctgggtgacagagcaagactctgtctcaaaaaaaaaaaaaaaaaaaaaaaaaaaattccagcccaaatgtcaatagtggcaagattgagaaaccttagattaattaaatggaaagcaaaggtccccaagcccaaggccagtgctagatattccacatcactcagattcttccccactagtggcccgatatttacaaagtgtggctccagattcagataaagaacatctgggtatgcctggagcttgcaagtgcaggcagtgggaatggctctgtcacttttcagctaacagccctgttgtgactacttgtccatttatttactcaaccaggattcagtgcaaaatgactcagatggcagtgtgacctgtggctcagaggaaggattctggagtcagaatggtgctattacttacttgcagtgaccttgggcaagtgccctaacctctctgagcctcaattttctcatctgaaatacagggtggtaataaaaagagcacttgctttatagggttattataaggaatttgtagaaagcactcagtcatcaccagctctcattgtctggtaactgcaggttacctaagggcaggagctggtctgtcttgctcatctcatataacagaatgcttaaataatagagacttaaagaatacagatacttacttatctcacataaaaagttaagaggagggtggcatgaaagttgattcagcagctcaaccctgttattaaggacccaggtttcttccacccttttgttctgcctccctatgtgtatgggcttttcatgcccaggcttactgcctcattgctacaaaatggctgctgttatgccaggcatcaatcttcataaaatcatattcaaaggcaggaaggaggaggtgacaaggatggccaaaataactctcgcttctctcactctctctctctttttttgtaatcccgccacccactatcaacttcccctaccatctcattggccagaacagggtcatatagccacccctaggctgatcactagcaaagggaacaggattcaccccatagggtgagattattcctgtattaacaaaattcaagttcctttaataaggaagaaattaagacagaagttgggtgggcagccacagtgtccaccatactgttcaccagtggccagcacaatccctattacaaagtaacgtttgacaaatgtttttgaatgaataaataaaccctcttatttgagggcatataagaagcttatggaacagtttggaggtttctcaagaaactaaaaattgagctaccatatgacctagcaataccattgctggatatatacttcccaaaaagggaaattagtatatcaaagaaatatacactcttatatttattgcagcactgtttacaatggctaagatttggaagtaacctaagcatccatcaacagatgaatgaataaagacaatgtagtacatatacacaatggagtactattcagccataaaaaagaatgagatcctgtcatttgcaacaacatgggtggaactggagagcattatgttaagtgaaataagcaggtacagaaaggcaaacatcacatgttctcactcattggtgggatttaaacatcaaaacaattgaactcatggacagagagagtagaaggatggttgccagaggctgggaagggtagtgagggcttggggagggggaggtggggatggttaatggataaaaatatagaaagaatgaataagacctactatttgatagcacaagaggatgactatagtcaataataacttaagtgaacattttaaaataaagaatgcagttggattgtaactcaaaagccaaatgcttgaggggatggatgccctatcctccataatgtgctcatttcactttgcatgcctctatcaaaacatctcatgtactccataaatacatacacctactatgtacccacaaaaattaaaaataaaacaaatgaagaagcttatgaataagacacatctctgatctcaagggtatccagttctattcgttgggataaggtatacagaaataaattcgacaatgatctctcttattggcccctccccatctccaaggctttgatgaggaaaccccctgagatcatttaagatctcagtatctcaactgacatttgtatatatcttaaaaaaaaaaaaagaatggctattctgcaaaagttactggggggaaaaaaaaacaaaaaaaaaccagaaatggctggtacgtaagcagtgttccagccctctaggcaatctctattccaaatagcagagggcatgagctggtggactgtggacttgtgttgtttggccatgagagtattttttaaaattgtaatcaacagtgaaacatcagaagagtttacataaaatatggatttgcagcgtcacttgaaaaattaaaggatctgattaacactggaaccacattcttgcatggcatggcaattatggctgacacagagttgtggctgcccttgagtcacagctgctcctttaaagcaggacatgctctcctgtttgctacagtctccacctttccctaaagcccctcgctcaagtcatttctttttttttttttttttttttttttttttgagacggagtcttattctgtcacccaggctggagtgcagtggtgtgatctcagctcactgcaacctccacctcctgggctcaagtgattctcctgtcttatcctcccaagtagctgggattacaggcacatgccaccaagcctggctaattttgtatttttagtagagacagggttttaccatgttggtcaggctgttctcaaactcctgacctcaagtgatccaccctccttggtctcccaaagtgctgggattacaggcgtgagccactgtgcccggcctcactcttcttatttatgttacctgcatggtcctggtataaatgtgagtctgtgcttcttgcatgcaaaggccaagggactccaaagaggctatcttgcctctctctgtttccccagactctgcacagtgcatgatttagaattttcactttctgaatgaaaagactgtaagttatttgaaggcacatagccttcatttctaacaattttctgccatcataagaggagagactacctagaaataaagccattagaggggaaagttgggtgcccctggattttccagttatgtgagctcataaattctttttacctaagccaagttgagttgtcattgtgtcatctacatccaaaagagctcaactgatataatcctctttccactgacgagaaggttataatctacttttttttttctgagacaaggtttcactctgtcacccaggctggagtacagtgacatcatcacggctcactgcagccttgacctcctgggctcaagcaatcctcccacctcagcctcctgagtagctgggatcacaggcatacaccactatgcctggaaaatttttgtatttttataataatagagatgcagtttcaccatattgcccaggttggtcttaaactcctgggctcaagaaatctgctcacctcagcttcccaaagtgctgagattgcaggcatgagccactgcagttgtaatctacttgagccctatatatacttatatatacttataggaaacaaggcaaaaagagtaataaaaagcagaatattctatagagaagggacaccccatcccaatgagaacttaagtacaggtcagttgtggtggcacacatctgtaatcccaacactttgggaggccaaagtgggcggatggctgagcccactttttattaagccccgggcaatatggtgaaacaccatctctacaaaaaatcagaaattagtcaggtgtggtggtgtgcacctgtagtcccagctacgtggaaggctgaggtgggaggatcgcttgagcccaggaggctgagattgcagtgagcggagattgcaccactgtactcctgcctgggtgacagaacaagactctgtctcaaaaaaataaaaataaaataaaataaaataaaatatctcaagtacagccatctcatttaaagatagggaaataaaaagctgatttaggggaacaggatcccagtggtcagccagtgagtggggaggcaagtaccaacacccgagcacccaacttctaggccaaggccctctgaaaatgttttctgctcaatcctctctgcagacatcttctgctgagaagtgttcagatttttctcagaggctgagtgaggtcaagtcaacccaattcgtccatgtaaatacaagtgatataccctttaaaaggtgctggcaagagacgtgttcacttgaagtcaagcttttttctttctcttggactccataatacctgtcatcatttatttataatcccactgagtatcctacttaggttttttggcacatctgggcactgagcaaggctaattaatcccccttcccccatgaattcctgggtaagaataattgctttatgagggtggttataggggtacccgaagcctcaaggaaaatcattacatctctgagtggatgtcgctcaggacaacgggtctttgctgtggccctgcccagacaaagcaccagcagcctgagggatttttccatcagcttggactccagtcttctcacccatctctcttttgtcacaccccaaaataataatcataatcataattaaaaacaggataatggtggaatcttcctctcagggttgctgaaagaagtaaaaagataatgcaaataaagtgtttcacaccttgcctaaaagtagtaagtactcattaagggaagagtagtagcaatgctaacaatgacaatatcagctaacattgattgagcacttcctgtataccaggccctgttctaaatgctttgcatgcgtctgatctcatttaagattctttccagctctttcactctcaggctgaatattctgatataaacaagacctattaaatgttagatgatacttgagtgaacagatgtctgattctagtgcctgttctattttcccctagcctgattgtctttattaagccctgggtttcctggcccaagttcctggtaagtggatgaacttggttttcttttctttcttcattttcattttctaaattaaataaaatttgttttagagttggagtctatgttgcccaggctggccttgcactcttgggttcaaatggtcctcccacctctgcctctcaagtatctggaattataggcacatacccagtgtgcctgactgagcctggttttctgaccaacccaaacatttacccatctctccttcctttcttttgcctatcacctatccatcaacctaatcatcccctcatccatctatatactcagcaaccaaattattcaactacatacccacccatccatctacccactcactcatctattcgttcactcacccacttactcatccatctttctttccattcattcatatattctatccattatccatcttgctaccttctcatccacctacttatccatttatccatctatccacccatccgtacaccatctgtctttccactcatccatctatctgcccattcacccacccacacaactactccctcatccaccccaaatattcatgcatctatccaccactcactcgccagtcatccatccgtccacccttctaatctatccatgtatctatctgcccacccagccatctcaacccatctaccacctaacatttgcagtgatgctctgtgctaatccctagcttgttgttttgggctccctccctgggaggaaaggtgagtgccatcagagggtccccacagaggaagacagataaaccagtgagcctctttgtggcctggaccttcaaagccactgacttccagggtctgtggccaaacaatgatgaaatgcacatggaaaatgagaagccctgcaattacatggaaagagacagaggctcagccctcccaatgttacagctgaatgcagcattccaggcatccctaccaagccactccaccatagggtggagatggatggaggcacatgcttccagcagagcaattagaggtaaactaatatctctttcccacagaggagcctgggaactccaagacgcaatggaaaggaggcgagtcagcaaaaggaggaaatcaaagccacagagatcaagagctaattaactgatcctcctaagataatgtttcattaaaatccagttcttctgccctgtggggactgatatctctcctactgcctctccattgcccttttccacccattcctgatctcatctgcctccgctctgatctttccccaagtcttctccctcctccaatccaacctccccccagctactagggtagacttttaaaggcacaagtctgaccatgtcactccctatttataagtcttcaccactcattgcctgagacaaagggcaaactcccaagataaggcaaaggccgttcattcatttaacacagatttcctcagtgcctctcctctctcacaagcttggggatggtaggacacagaaacaagtttctgacccttgccctgtttctccagcttctttacccaccactcctttccacattcctgcatttcagcaaaaactttccaacctccggcttagtgatagccagtccctagggaaactgttgttagtatccatgctttgctcagctcacttccacattgactctgggcttggccttgtgacttgcatttaccagtggaatgtggtggcagtaatgccagttccaggcctaagccttgaaagggtcgggaagcttctgcttttgtgctcttgggagctctgaaccactgtgtaggcagccaggctaccctgctggaagggaccatgtggaaaaaccacatggaaagtgagaagccctgcaattacatggaaagagaccagaggctcagccctcccaatgttacagctgaatgcagccttccagccatacctaccaaggcaccaggcatatgaatgaagtcgtcgtggacgtcccagcctcacctaacatctgactgcagctgcatgagagacccccaagtgagagcagcagcagaaccatccaactataagccccattctctttctattagttcttatgagagctattcattctcatgagctttttagaaagtgccaacctggctgggcactgtggttcacgcctgtaatcccagcactttgggaggctaagattggtggatcacctgaggtcaggagtttgagaccagcctgaccaacatggtgaaaccccgtctctactaaaaaaattacaaaaattagccaagcgtgttggcaggcacctgtaattccagctactcaggaggctgaggcaggagaattgcttgaacccaggaggtggaggttgcagtgagccaagatcatgctgctagactccagcctgggcaacagagtgagattccatctcaaaacacaaaccaaaagcgccaatccacaaagacatgagaaataataaaatagttttgtgttaagtcactacatcttggagttgtttgttacacagcacgagatatctgatacagaggccttgctcctgctatttccacagcttagaatgtttctccaaccccagccatcttctttaccccacatggtgaactcctattcacctttcagagcccatattcagcatcaccttccctgcctcccatagtctgagttaatgtctctttcctctgggaaactgtatgagactaacctacaatacttatttttctgtttcttccgctggctatgaatgacaatatttactcatgtaatgctcacaagaaccctatgagggagacggtattattatccattatcctattttacaggtgaataagctggggcacagagaaatgcccccaaatcaccctggtattaagtggctcagcagagatttaagcccactcagaacccaagctcttgtccactgtggcttcttagtaaagtataaaaaaggtatgacatttattggtctcatttaacacaaaatccagaagtaggtgatgccaggacctgtctcagcaacagcctagctatctcagggtccttgtttgatttctgtgagagtctcttgtccacatcgtcacaaaacggctgccatgctcagcctctcacatgacaactcccagagagggaggaagaaggaacatctcccatatttcagaagctccccactgattttcccagccatctcattggtcagtactggatcacatgaccaccactagcccagttactggcaaggggaacctgatatccatgtttggcttggccctgtcttgatttggaggttgggcccattttcttgagcacaaggctgcctaatatctgaagaaagccagggtttcttctagtgaggaagttggccaatcaattagtgtctcttctgcagtggtcagctcttagaacacctgaaataaagtcacatacagaccctgttcatcccaaggatccagatgtcccaaaggtcaatctcccagatttgcataatgtgagttgtcttagtccatttgtgttgctataaaggaatacctaaggctgcataatttatagagaaaagaggcttatttggctcaatgttctgcaggctatacaagatgtggcactggcatctgcttctggtgagggcctcaggctgcttccactcatgctgaaaggggaagggcagcccgtgtgtgcagagacctcatggcaagagaggaagcaagaaagaggcaagggaggcaccggctcttttcaacaaccagctcttgcaggaactactagagtgagaactcacttcttaccatggggagggcaccaggcctttcatgagggatcaactcccatgacccaaacccctcccattagaccacacctccaacattgggaatcaaatttcaacatgaggtttgcaaaggtcaaacatcctaactatagcatgggtgcacctgccttgtctctcccaggccactgtgaagctccacggaaggtcctggggcaataagatagtacactgccagctcttccccaactcatcaccctcccatccttgcagacacacactctgaaccatgtctcaaatggccatgactcccaaatgccagaccaataacgtgtttgcattttcactggtccatcatgaaatgaatgagaaaaaacagggacaatggaatgagatttgtataaagctaaattgattccatttaaaggatgatggtgatttactttcctacttaaactctctcatggcttcccagggcacttagcataaagcccagcctcctcttcctgacaaggtctgctcccagagtggctcctgccaccccctcactcagccacagccttcctgggatgctctctttctccagcacaccaaaccccttgcctctttagagttctttggatttgtagtctctttctcctggaatgttcttcctctagttctttacaaagctgcgatctctcatcttgatctcaactcctatcgccacctgcctggagacttttcctgactgcctccaaggccacaggcacatccatctccgtgtcagcatccatcacctcctgctgtttgcttgtcctcagcatctgacactgtatttatgctgatttgtttctttactggatggcctctgctgcccaaatgtgaaatctatgagggcagagaccttgcccggactagtgcagtcccttcctccctggtctccagcttcccagccctcagcatgcacggtgagatggatcctcctagaatacaagttaaaccatggcccttctctgcccagagccttccgtggctgctggccacactgcctccctcctgctcctagaacctgccccagagcttcccatcttcacatttgccattgcatctctccagaacattctttcctcagatgccccagtggtttgctcctctcatttccatcgagtttctgttcaaagctcccccagggaggccattcctgctcactctctttcaaatctcacttcccatctcctgactcctttattcttctccaaagcacttatctccatttgaactgctttatattttacttatttgcctcatttcttacagtttctcccatgagaatgtcagcgccgtgaagacagggatatatcatttttttggtctgtgttactcactgccgggtcctgttgtctagaacagtgcctggtacaatgagaggtgctcaaaatatttacttaaaaagtgcataacagctttcttgaggtataattcatatatcataaaatttgcccacatgaccaggaacagcagctcacacctataatcttagcactttgcgaggctgaggagggaggatcatttgagcccaggagtttgagaccagcctgggcaacatggcaaaacccccctctatcaaaatatacaaaaacaaaaattagccaggcaggcatggtggctcaggcctgtagtcccagctactcaggaggctgaggtgggaggatagctagagcctgagaggcagaggttgcagtgagctgaaatcacaccactgcactccagcctgggtgacaaagtgtgacccctgtctcaaaaaaaaaaaaaaaaattgcccatttactagtacattcacagaatttcacaaccatcacagtgatccattttagtaggtttcattagtggtcactccctacttctccctatttccccatccctggaaaccactagccaacttcatgtctctatagatttgcctattctggacatttcatgtacattcagtcctataataagtggccttttgtgactggcttttttctcttagcataatattttcaaggctcatttgtgttgtagcatatgtcagtacttgattcctttttattgacaaatattattccattggaatgggggatacatcacattttgcttatccatttatcagttggtggacatctggattgtttccaccttttgggctattcaatatagacttttgagtgagtggttgtgttaattccaatataaaacctacctttctgctttaggggtattaaaatatcctttcataagctgacagtaggagtaaatgtatttcttaatgtccttacctggcaaaataaaacactgggtctttctgttgactttaatggtacaagggtatgaaaggccaaagtcttggagctgcagatcactaggacctgggttataacaaaggctaggtcagcggctcagggaagccaagccctgtccctctggccctgccatgtggttcagaccatgactggtaaacaagagagcataacgcagcacttctcaaactggggtatggtacccctctgagggcacatactgatgtcctgaagagaaagactacatttcccagcctcctgtctgtccagcaagctgtggtcatgtgattgagttctgaccaatgggatgaatgcaggggtttttctcttctttgcttcaccctctttcctgctgggtggaatgtggacaaaatggctggagcttaagcagccataacggcccctgaggtggaaaccactggttacagatgctagagggtccagaaaggagggaacctcatgattgtggagatgtcacaccacctctggcctcccgtatctgcttgaaagagaaaaaaaaaatgtggccatgcatggtggctcatgcctgtaatcccagcactttgggaggccgaggtgggcagatcacctgaggtcaggaattcaagaccagcctggccaacatggtgaaaccccgtctctactaaaaatacaaaaattagctgggtgtagtggcacatgcccataatcccagctactcaggaggctgaggtaggagaatcccttgaatccgggaggcggaggttgcagtgagctgagatctcaccactgcactccagcctgggagacagagcaagactccatctcaaaaaaaaaaaaaaaaaaaaacctgtggtattgaatgaaagcatgttaatatataacatgttgctatgttactttgagaagtctgtcactcactgccaaatcccatcccacctgatgtgcctccatgacctcctcacagatgaggaaactgacgtgaggcacatctgccctgggatattatttctatacaaagatttgagagaaaaaaccaaatttctctttttatttctcccaaggcttatttaatccatttcaccccttcttttttattttaacatgaatgcatgcattctggtgaaggatggacagcatccggtgaattttaaagagagcttttgtgttgtctgcttgttaccagggtctaccccaaagtcctctaatgcggcagtccccaacctttttggcaccagggactgatttcatagaagacaattcttccagcgacccaggggtgggggtgggaggtatggtttcaggatggttcaagtgcattacgtttattgtgcactttatttatattattattacattgtttgaaatagtgagataattatacaactcaccataatgtagaatcagtgggagccctgagcttgttttccttcagctagatggtcccatctgggggtgatgggagacagtgatagatgaccaggcattagattctcataaggagtgcgaaacctagattcctcgcctgtgcagttcacaatagggttcgccctcctatgagaatctaatggtgccactgatctgacaggaggtggagctcaggcagtaatgtgagtgatggggagtggctgtaaatgtagatgaagctttgctcactcactcgccattcacctcctgttgtgcagcccatttcttaataggccaaggacctatactgatccgtggcccaggggttgtggacccctgctctaatgggtacccagtccctctgctgccagccggaggatcactgaaagaaagatcctgaacactgtctcaggcagcagagggtcctgcatttgaattccaggtctattacctcttagccacacgttctcgggcaaaccacttcacctctctgaccctcagtttctttctctgtaaaaacggggatactcatctatgccttggagggtgggtaaaggtgtgactcagttctgtctgtgagaggcctgggcccacagcaagggacagagtagatgctctgtgctctcctgtcccaagagctgacctcaccattccaggcacggccaatgccctccatcagaatcacactcagaggcagttccacaaacaaagatggtttaatagatttcagcatgtttccacttgacaatgttatacgaaaatagaatctttattaaaatagcaaggcataacaatcactgctactcaggaaacactgtgtttattctttttaatcatcaaaatcaatgactttgggcaagacctgtgaaatctcagagcctgtttctccatctggagaacaggcaggtagggcattgccagctccctgtgagtgggggccactggtgggaggagatggccctggtcgcccatgggatgagaaacttactcctgcttctgtccctggagaaggtcagggagatgccagtgtggccttaaggcaattctaacacttgcttatctcgttttgtaacagagaagagagagctctcagccttggccacaccagcatggagcccccttccccagcgaatttatttttcatggtcactttctatttttggcagtgagtgatacatgttatccactattggcagcaattggggggaaaaaaagttcattttaaaaacaaagtttaggccgggcatggtggctcatgcctgtaatcctagcactttgggaggcccaggcaggcaaatcacgaggtcaggagttcgagaccagcctgaccaacatggggaaaccccgtctctactaaaaatacaaaaatcagttgggcgtggtggtgtgcgcctgtaatctcagctacttgggaagctgaggcagaagcattgcttaaacccaggaggtggaggttgtggtgagctgagatcgtgccattgcactccagcctgggcaataagcgtgaaactccgtctcaaaaaaaaaaaaaaaagtttaaaaagcgagtctgtttaaaggagaatatttggtaaacaacaatattaaaatatagcaaataatagtaacaataatcacaatggtaaggaaacacttcattagatcaacttaagagtattttattcttggctgggcgcggtggctcacacctgtaatcccagcactttgggaggccgaggcgggcagatcacgagctcaggagatcaagaccatcctggctaatacggtgaaatcccatctctactaaaaatccaaaaattagccgggtgtggtggcgggtgcctgtagtcccagctactcaggaggctgaggcaggagaatggtgtgaacacgggaggcagagcttgcagtgagccgagatcacgccactgcactctagcctgggcagcagagcgagactccatctcaaaaaaaaaaaaaaaaaaagagtatttcattcttgccactgagcttaaaaagaaagaaagaaagaaagagtattcctaacatatgtccagtaattttgattcttaagcaagggatgaagaaatacaatggcatccaggtaacttcctaactagcgcatagcaggtagctaacccactcatctctccctcttttctttatagcttctattttttttaaagagaaaaataacgattaaaacaagggcaggtttaaataatcgtctcctgagctgcacttcagtatctcaggtaacagctggagctgcctggtgggagcacatcttttccttgagtgtaattcactaatgactgtggttccaaggaggtgcgacctttaaagggaattggcccttctttgaaggcaggtgagaatctagtctcagtgacaacccagcctgatttggaaggggggagtcataagggttttcgcccagcacaccagggttgcagcctgcgcaagaccttccatagctatttctgccggcttgcttccttcccttcccagccacgatgaggcagctgagggttgccacggaaaccggctctgtcctcccactggaggctgccagctctgatttcctgcagagttaagaaggaggcggcagtgggggtcacccaggcgtgaagatgggtttccctggggatatcctgcctcctgccaatcacagcgtctctctgggaatcctgggggtgcctggaggctgaggcccagggaagcccccaaaccccagtgctgctctgagaagagactagcctctgggacattcagaggtctggggttcttttatctccctccagctaaagctagagggacctcattatgtgtcttacaagatgtacccaagtttaggtgcctctggctctgtcagctcctgaagtcgagaagaattgtcccatcaccagtccccttgagcccaaagaacaggagttgctcatccagcatttgctcctgggacagtaaatctgcctgcagagttctacagcttatgagctatgtggccccaggcaagtcacctcacctctcagttttctcatctatgaagtgggcacaaccctccttctcttcatagagatgctgtgaggagtagacatactgtctgtagggtctctcgcaggcatttaaagggtctcaataaacaggactttatattaataaaaatagcatcataaaaaaggtttgcaggccatttttctctttaagctgttttttattttaattaattatttatttattgagacagagtcttgctctgtcgcccaggctggagtgccgtggcgcagtctcagttcactgcaacctccacctcctgggttcaagcaattctggtgcctcagcctcctgaatagctgggattacaggcacgcaccgccacacctgactaatttttttatgtttagtagagacggggtttcgccatgttggccaggctggtcttgaactcccgacctcaagtgatccgcccacctcggcctcccaaagtgctgggattacaggcaagccggggcaaaggcaaattttcatcactgatacatttgttcaaagggtggtgcactcaggctgggttggaccaattagctggtccccaccacctcttacaatgtcacttctaagagttagaacagggtctcacactcagatgccttcaggtccaggaggcgctgtgaatgcagaagcagacccggtcagaaccctggtgaagccgagagcacatgtcctgcataagggaggcggctgccactcagctctggccaagagttacccttgggaatgtgagcccagtgtggccagatataccaagttttcaagagaagctggacattttgaatgaactctcccaaagatgataacaactaaggcatttttttaagtgaagtccaaacaaaacacgtctgcagactggatcgtgatcacagttggggcttctgcactagaatgcatgaaatcggcaccttcttttttggcttgatcagtctaaggagtcctggctggctccttccagccatcttgtctgggctgtgtcttccttagctccctacctgagtgctgacactgagaaagcccatcccatctggtgcctgtcactctagaacagagaactccactcctcagagcccagtgtttggagggtgcccctgttctgcaccgggaatgcatcagccttgggggaagctctcctgcattttctcaagtagtgtgagcaatggggcaatctggcaaatggggccccagggaagcagatcttctaagggactcctttggttttagctagtttaaggattattgggggactgactgctgaatgacatcaatggacacaaaggacatcctgagtggcctttctgtggccagcatccgctttgactggataaggcccgggccatgctagctcataagaactaggaaggtgacacctccgggagttgggggcagagcagtgaagactcctagttctgccttatctgaatagcatttgtggatatcacgaggtgagagtaacgaggtgaattgggagcagacaaagcctgattttggaaagaaaactttgcagtggataatccatagagctttcaatgtcttttctttgttcaccctcttagcttttccctcccctggacccagccttctgggagaaaagcagggaagtggtaatgctagcacctgcacccgggccaactgtgcacacagaaagctgggaggctggggcaggctggggcaggctgggcagaggcgagcacgtggatccatctgctccctgtgtcatgggcggatgcggtagcggacgggcacgtcgtgttccggctgcatcagaccgaagccgtacctgctgaggtcaaactcagggatctccacatctgcgttgatcagctccaagtccaagtgcaccagcacaaggaacacaaatctgcagagagatggcatggaaggtgtgaaggagaggagtagggcagggggttatcgggaacaaggcaggggagccatggctgcctcctaagtctgactccaactttgagtaaagtgaggagaggagtgaggaagtagaagaaacgcatttgctgctcaccacatttgccagccccctgtaaggttaggcaggcccgtggatgagttctggtgaatgggctgtgtgcagaagtggcctgtgtcactcctgtgtcaaagcattcgcgagccagtgtgtggctctccagctgtccctcctgcctggcagccatgcaggcttcacattgagacggtggagccgaaagagggaaagagcctggcccgagtctgtgcacagagtggggaagccctccaatcccacagctgataccgtgtgagtggaactacacctctgttggtaaaagccactgagactcggcaggtgcagagctgagcctgtgctgattaatacggcgactcctctggatcctccagcccacacactttgccgcctttccccacactcctggaaccctcactgtctatcttggccaggactgctgctaacccttaggtgtctttgtgagattagaaacaggcatcgctctcaagacattttactgccatctctgagaaaattgtcctaaatagaccaactttgcaagaacaagcactctctactgccatcttctgggaaaactgtcataataactattcgcagctgccatgcctatgatgtaatcagtgcccccataaatgtggaggcagccctacgggggatgtcaacggttgctgcctccctgcctcatcttaccaatgcccatgttcgtaagggtcaggagaatatcttatgactcttttcccaccactattccctaccccaacccaggcgcccgatgcagcactgagcacatggtggggattcttttgtctcactgaaggagtgaagaagagggcagatgaggagagaggggagttaacactctggacagatctgggctgtgccgcttatgggaatgtggccctcgccaagttcttacccactctgggtctcagttctcccatctggtcaaagaggggaaaggcatgttgagtctcttccagctctgaggctgtaggaaactagagggtgagtttctaagggatggcggttttgtgcccacccctggatttgaactcctgcacctccacttcctgggaacacggcaaatgatctgacctgcctagactcggttttagatggaccagcagggttgtcatgacaattcagtgagataaaaataacaacaaattagctaatttattggaacactgtgcgctaggcaccatctaagcatttagtacccgctatctctttttatctgtccaaaaacttgatgaggtaggaatgccagtcggttctgctctaacacttgttttgaacaggtgaatttgttccaataggattgatatattagggcaccatttgaatataatgcaagtttcacatttgctcacgtgcaatttcacttgtgagaaacatgaggtgaagacgaaagactgcacccagctgaacctgggtgtgcagaaatccataaaatatacacatgcacacaactaagcatcgatctacagccacagttattacagcacttacatagttcttagccaggtaacatgtataaaactttactaccattttttttactgggttcttctctctctctcttttttttttattatgtcactgatgaggtttttgagtgttggccccagtcccccttttccctcaatccctgcagttttttctttctttctttcttttttttttttttttttttttctggagacagagtctcactctgtcgcccaggctggagtgcaacggcgcaatcttggctcactgcaatctccacctcctgggttcaagagattctcctgcctcagcctcctgagtagttgggattacaggcacgctccaccacacccggccaatttttgtatttttagtagagacggggtttcaccatgttggctaggctggtctccaactcctggcctcaaatgatctgcccacctcggcctcccaaagtgctgggattacaggcgtgaatccctgcagtttttgttgcatgatttcacacagcaaggtgattttaaggaatgcatatgagctgtattatgttcataattgactccattttcttgaggaaactgaggctaaaggtttatgtaacgtgcccactcacttagcacaatgcatgcacaataatgatattaacaattatggtaataattaacatttttcaaatgcctacaatgagccagacagtgggttaagaacttagaaagatccaattcatttatcctgacactcctggggtatagttataatcagaaccctcattttacagttgaggaaacaggctcagaaggtaacccagcttatgattgcacaggggctggacaggaggacagggcagatgtcataacccctggtccaatctgtttgtgatcctggtggccaaagctcctggggttcaagggagataatttatgaggctctcggccccacaggtattaaaataaccaagtgggaacagtgaagttcggccagttcctaacatgaagttctgaacatgcggcagcagctgcagacgggtagctacggtcagctgaaaggaatgtccagtatttggaatctggacaccagtcttggagggaagaacctgctgccagatctgattatttcaaaagaaatccgaaatctggcttttttacacgagctcttctgatttataaaagcacacagttgtaaaaccacaaataagagatggctcacgggctgtccatgtgaagcctctgccaaaccattctcctggctgagccctcagtcccaggagagaagggcgcctgccaaccaggggatcaggagccaccctggccctgccctggccccccactcactgtttgatgctgttgaccgcataactcctccccaggcagtgattgtgccccgccccccagggcatgttgtaattcttcagccgtttcccatccttgtaaaagtctttcttctctgatccgtcagggttcaggaatcggttgtatttaaatacctgaaataggaagaaggtccttttctgaccccattcccagaacaagctcacaccaagaaaaatgtatgaggatgttcatgacagtcatgtttataagagggaaaaactggaaaccatatacaggtcaattgataggggattggttaaaaaattatggcaaaaggtttgtgtgtactgacatggaaagaatttctacaattggttgttgagtgaaaaaagcaagtttcagaatagtatatattgcatgatcctatacacacaccaatcttttcatggcatgtgaatgtgttgtgtgtatgcctgtaaagccatgaaaacaattcgcaaggcacactccaaaccttggtcagagaactctgtagaactggagaagaagggaaatacatattttttacatttaagtatatatttctctgtatttctttatattctatgatatatattacttttgtaatgtaaaataaaagaaattaaaatattttttaaaaagaaaatgccaatttcctttggttacactgcacagtggtaaggcaagggttgtagctgagcacagagcttggcatggagtagctgccgactgaaagatgggtggaaggataggtgaatgaaccagtggatagactaagagatggaaatgtggatggaaagatggatgaatggagggatggatagatggatggatgggtagatggggtggatggatggatgggtagatgggtgaatgaatgggtagattgatgggtggatggatgaataaatggatgaatggacaaatggatggatggatgagtagatgggtggatagatggatggatgggtggataagtagaagaatgggtggatggacatatgagtgagtgggtagataaatgagtgggtggatggatggataaatgagtagatgattgaatggacagacggatggatagatggatggattcatgggtaggtgggtggatgaaagagtagcttcatgggtggatggatggatggatgggtggatggatagattaatggatgggtagatgggtgagtatgtggatggatggatggatgcatggatgcatgggtggatggatagattaatggatggatgggtgaatttgtgaatggatgaatggacagatggatgcatgggtagatgagtggatggatggatagatgagtggatgggtggctggatggataaatgaatgggtagatgggtggatgaaagggtaaattggtgggtggatggatgaatggatgggcggatggatagatgaatggataggtagataagtgagtgtgtggatggatggatgaatacatgaatagacagatgcatgagtagatgggcagatgaatgaatggatggatagatgagcatgtagtttagggtctgacacacagtaaacacccaatctgttagcaattgtgaaagtttacttcttctcaaagtctggggcaaggcaaaagtgttgagaaactgacattataacaatctgaaataaggaaaatggctgagctatcacaaagcactcagtgtgaatgaacatcccctcatgttctagggttcctcagagacccttgaacatgaggggatctgggtctgactccaagagaagctgtgaaaaaaggtaggagccaaagagatatcagaaggctggggagagagtggggccatcaatatctgcttatgcatgatcccatttaatcttcctatcaatctcatgaggcaggtgctattatgaggtccatttcacaggtgaggaagcaaacacagagaggtgaagcaatctgggcaatgtcacatagcaaacaaagagcagagccaggctgccactcagatctggctcatcccaaagtcactgattgttctcccacagaccccatatgaccaggcgcccctgccatttacctctgggtctgtgtagatttctgggtctctctgggggctcaggaaggggaagaggaggaggcggtcaccacgtcgcaggttgaattctcgcccgtctgccatgggcatggccaggtccaccacaacctcgcgggtgatgaagggggcagctgtaagcctgaggctctcactcagcacgctatctgcatggggcaggtgcaaggaagagtcagcgggctatcccttcacctgctcatatgccaaccccagctcttattttacagaggaagatgaagaggctcagagagggtgcctgcctcgcccacacagtcacatagcaaggtgaaaaaggacacacgatgacatgtggtctctgtggtccctcagagacgtttgaacatgagggtatccaggtctgaccccaagagaagttgtgagggaaggtgggagctagggagatatcagaaggctggggagagagtagggccatcaatctctgttcctgtctgcccggcatatatttctcttctggaaacgggcccctgattttcctctagggtccacccctctctcattctcaggggttagactgctgcttctatgctcaactcctgggatggggctgtgactggccaatcagagcatccctctgagccctgtgattggttcaggatggacacatgacccaaagaaagccaatgagacacagtcttgggactcttggtgggaacactgtaagagattcagagtctcacagagccaggaggaagtcagccttgagctgccaacagctactgccagcctgagactggagccaacccagtgggaaacagggctgagaggtggagaggaactgagtagtcctgacgacattgttaaagtgcatggatccacctgtgcctgaagccaatcctctgggctttttagtgacatgtctcaaagtaccttttcaccttagtcaattgaagttaggttttctgtcacttgacccctagctgaggctggagtatggagatgccaggtgtgtgaagataggaggcttagggagaccctaggtcggaggacacactgatggaccctggaagacaggagtccatgttggggagggctttgggggtccatgatgacgcagtcttaggggctatcttggagggtctgacgatctcaccaagcacaggtgtgctgtctagaaccttctgtgggagagtggtcgtctgcgagacaggctgctccgcttgccaaaggatactctcgagctctccgcggacagcagccagggcttcaggattcttgagaaggaagagcaggagccagaaggcagcgggacccatattcccctgcaaggagaagggcccctgttatgccattatgagggcagagctgactcgtctctgccagggacacagctcgggccaagacagaggggccagtaggcctgggttcccactgctgccaaacacccaggcatgaccagtgtctatctccagcctcaggacatggccaaaactgccctgtggcccaaaatacctacttcaaggccactcgtggcatccctgactgtgtgcaaagtcactaatcctaggtcacacaggtaatcttcatagctaatcagcaaaacagtgtcagtaataggaacagggtatatcagttaagactgttcacatctgagaatgatcacattgttggccccaattcttccccaatcgcagaatccacgctccttaccatgtgaatttgctgttcctcctattcaagagccagagcgtatttcccctgccctttgaatttatgctcagccgtggacttgctttggccaatagattgaggtggaattgaaggaacagccactctacgcctaagccgcgagagactttgtgtttccacttgctcggcaagcccactgatcccaagaggaggatgagagactcatggacagagctgagctgccccaatgagccagacccacagacccgtgagttaaataaatgctgatgggtgtatgccgctgatgagttgttatggatgtttgttatgcaacaatagctaactggtgtgatatctaaagatttgcttccaaatataatcattcttgatgtagtttgggaagcaaaaagttccctatatgctttgtatcttcaaattctatcagtcacttgaagaataaatgtgtgtgtgttgtgtacgtataaaacaaagccgcaatcatcattgatgactgaaagctatgaataaaaattatttaaacttcccaatagataaacacttaggaaaacgagtggaatttcttgcttcaaggcttcagtcttagctgaacattttcatacacattttagcctcagctctttggtatgtggctaaaatgtgtatatggcaccctttagtgatccagatatgggaagaataccaactaatctcaatttgggggaaggtttttgtctgccgtgactattctattcaatcataataatggaatattaaatcatcattaaatatcatgtttacccactaatttcattacagacataattacacatgggcaaaaggacatatgcacaaagataattattgcagtgctcatgtaatagaaaaatgctggaaacaatctcatgtctatcaataagagatcaatgagatcaatgaagatccatccattggatgatgtgatgcaggaagtcattaaaaagaagctggctctgtgtgtaccgatgtgggactgtagccaagacacacagaagcatgcaaacgcaaggtgcagggtggtggctcagcatgctgccatttgtgtgtttgtttaaagagaaatatacatgaagaagtacagaccatctctttttttttttgagacagggtcttgctctgtcacccagggtggaatgcagtggcacaatcatagctcactgcagcctcgacctcctaggctcaagtgatccttctgccttagcctcccaaggagctggggccacaggcatgtgctacccagctaggttttttttttttttttggtagagatggaggtctccctatgtttcccaggctgatctcaaactcctggcctcgagcagtcctcctgccacagcctcccaaagaagcacagaccatctctaagagacaccagaaacgggtaactgaggttaccttgggacagaagctgggaagacaagaggataaggaggaaggaggctgactttccttgcaaataccttttaaactgttcaaaattttttaatggacacactaattttaagtgaaacagaagccacccaggctggagtgcaatggcacgatcgtggctcactgcaacctccacctcctgggctcaagtgatcctcctacttcagcctcccaagtagctgatacaagcatgcaccaccatgcccggctaatctttctattttttgtaaagatgaggtctcactatgtttcccaggctgtatccaaatcatttctacagtgatgtacaatgtcatgagagatgctcatgttacaatattaaaccaaatagaaggttagattaaaacagctgcatgatcttaaccacagaagaaaaacctatggggaaaggctggaaagaaatgcaccatagcattagtgatggtgagatagattttgccttcctctttagtgcccgtgaggccaggaggaaccacactcctctgctcaatacttccatcacgcaggtgccattattaggccttttactgaaaaggaaaacgaagtactccccggtcactacccactgcccagcatatagtggaggctcactgatatttgtcaaataaacatctgcatccctttggattagaggtggagctccaagacagcctgggaggtgggctagaagatccctggactgagaccaggtagaggtgggttcaaatcccagctccccactttctgtgactgtggacaagtcacgtccccctttgggtctcaacactgggggtaacattgccacctcctgggtggacgcaagggtccagtgaggctgaatgcaagcaatcccacacgtgctgcgcccatagtaggtgctcagaagtggttactcctcccccactggcccctcccctggatttgaaaacaagtcgggggggcctccggccctttctgagagttccaccagcacctcaggtccagctgacacagcaaggtcacctgctgtccatcacttaaatagccaggcaaatgcggatgataaataattcaacaccagcttagctcagcgccaaggccattttatctggcccagatggttagatgggggccaccgctcattaattaccaagcaggagtggaacacatgggcgcttggctatctctgcctgcaggaaaaagctgtggcaagttagggaggtgaccaagaccgccttttacccaactgcacagatgtgagtgtgagtgtgtgtgtgtgtgtgtgtgtgtgcacacacaaccataagagatcctgaatttgccaccctggaatttgagctttcacccacggagccttgcctccgtttactcaggaagacacttcttgtttgtcttcattccctcctactgcagccaaaggccatgacccaaaagcagtgccacccctgttctagctttcctgtgaatggcagtggctgacctctgggaggcactgactgcgggccagaccacacccttggtgattcacatgctccttcttgttgcctcctgacaacatggcccatcagtggaagtgggggacttccgctgcccgctcctgcctgcatccgcttccttgtcgttggtaacagcaccccactttccttcaaagaaccacctcctcttaagtctaagtccatgtgggccatccaggactgacccatccttccagacttcaagtgtgggcatgggacccaggcggaggcactgagtgatccacgcagagtggggcatatgacgtgggctgggccagtgagtatcagtcttgggagctgtgctagaatttaggggaagggaagccctcctccatgggattgctaaattgcctagagctactggaggccattgtagtcatcccccagggggagaccctctgaggatgtagcctggcagaagaagggagacctgagggatgggggtcacagattgtgtttcttttaatttttatgatttagaagattccaacggaataaaagaatatcccgagtgtgatgatgtgttagtgtaggtcataaattgtaacaaatgtgccactctgctgagggacaccagcgatggagaggcgaggcattgggagaagggggctaagggagatccctgcacctttccttcaattttgttgtgaacctaaatctgctgtaaaaatagagtctatttaaaacaaacaaacaaaagccctaagtgcaatgtgggattgtggattggctcctggaagagaaaaagaatattagtagaaaaactggggcaatgtgaataaagtatagactttagttactagcaatgtcccaatgtgaatttcttagtcttgatgaatgtattgtggttatgtaacattagggaaagctgggtgaagggtatttgggaactcctgtactatctttgcaactcttttataatctaaaattatttcaagataaaactactgaagacaaaaaaaaaaacaaacaaaaaaaccaaccctctttacagatggtgaaacttaagcccagaaaagtgacttgtttgaggtcacataactagtttagtggcagaggtgagattccacccgagtctgtctgactctcaatactgtggttttgctttctactccgttgtcagatgcctcaaggattcttctcgatgatcactatctcagcggagctatgtgcaggcccagcagctcccgtggccccctcccctacctctcaggaccacccaggaatttccagggatgtgtggctgtggctgctgaggatgtgatggggtgaaggccaagccagatatcgggaaggaagagaaggatcagatgtgatggatggggctgagggacatcatgtcaatcaatggtttcagtcctggcattaccagcatcagtgggctcagagctggcagggaagcctgacctgtgtttggaaactctcctccgtctgccccccaccaccccaccccaccttcccttacagcctcctcttccccttgcctggaccttaggtctcggcccacagagtcctccctggatgcctgagactcccactgctccttccatcactctcgattccaggttcaggggttctggattcaggaagctgttgtgaggatcctatgagatggtggttgcaaagtgctcaacaggatgcttggcccagggtaagtgctcagtatcttttgagattattattcctgactcatcatctccgacctgacagcagcaatcacagctaccatttttcagcctctctgcagcatctgacccagcttcccactcccggctctcctcccaccttcctggcccctcctcctcacccttcccaccactggagagccccagggatgcccccttcttcacccaccctcgcctgcagtatctcctccagtcctgaggatttaaactcctctatgctgacaactcccaagcctggacctcaaacttgaactccagactctcttctccaggtgtccactcccccatctccatctcaaattcaacatacccaaagcccaacccccgatcttctccctgaaacttcctcctcccgccatctccctcttctgcccatggctctgccatccctcctgtcactcaggcccaaacctggattcatccttgatggcctcccccaaggtcccatccaacagcggatcctgttggctttactttgatatatgttcagaatctaaccacccctgaccctggcccagcagcaccctctcttgtctggatcctgctgctcctctctgctctccctgcctctgcttccccaccccctacagtctcttgtcagcgctgcagccagaatgatccctctaaagcgaaagacaggccaggttcttcctctgctcagagccctacagcaggcacctgtctcactcacagtaaaagccaaagccctccccatggcctacagggacctgtgtggtccggcagctctgcctccccaccgtgtcacccttagtcctgcctcagggcctttgcacttgctgctccctgcctgggaaacttcattctatatatttacatggttcacccctcacttccttcagtctctgctcagatgtcacctttcagtgaggccttcctgggcctgccttcctgctgcatctcttctccatagaacacattccctctaatacttttttttttttttgagatgggagtctcactctgttgcccaggctggagtgcagtggtgccatctcggctcactgcaacctccacctcccgggttcaagtgattctcatgtctcagcctcctgagtagctgggattacgggcctgtgcgaccatgcctggctaatttttgtatttttagtagagtcagggtttcatcatgttggccaggctggtctcaaactcctgatctcaagttatctgcctgccttggcctctcaaagtgctgggattacaggcgtgagccactgcgcctgacttctaatacattttagatgcttacttgtttgtttatttatttatttatttttgagacagggtctcactatgtcacccaagctggagtgcagtggcacaatcatggctcattgcagccttgacctcctaggctcaagcaatgctcttgcctcagcctcccaagtagctgggactacaggtgcgcaccatcacgcccagcttttctacaaaaaaaataaggtagtttttgcagagatggggtcttgctatgttgcccaggctggtcttgaactctaggactcaaatgatgttcctctctaacttcccaaagcactgtgatgacagcttatgtgtttattaattgtctatcttctcccaccagaatgccagctccctaagggcagggatttttgtctgttttgctcaccgctctatccccagcttctagaatggggcctggcccatggtaggtgctctaaatatttgttgaagatgtttcttgagcacttgttatctgcaaggcacagttacaaaattgcacatgtattcctgcctcctttcatcttcacaaccacgtcttgaaacgggtgctaccatctccattttacagatgagtaaaccgaggtgctcagaggttaagtgactgacttgccaggaagtgtcaaaatcaggattcaaactcaggctgggaggtcacagagcctgtgccagaaactcctaggccaagtaccctcttggctccactcccaaaaggcccttgaaaagttttcccacctgcctgaattctggacgctgtcaacgactcaacctcagaggacatcttgtccccagctcctgcccagctctcctggccctgccaaaggctgttccctggactttctgccactcaaacccctcagccagcatccagttttgctgacaccagtcattcccacgagagttctggagacactttggagctccaagtcatctctgcacataaatatgttattaggcactgatgtgggggacaactgccaattgatcccagtccccaccccttgccagtctctgcctgcaaggacagttaatggctctgaggaaactaaaaataagctgcaagtcgatgggagaggaattacccagaaatgtcagcttgtgcaactgtcaccgtcgaagtggggccaagagaaagatggggcttggggatcaggagagagggcaggaaccaggcctggagctgtgcagcatggaaggctaccatctttctctcactccaatatctggtccatgaccaagtccactgactctgtcttcctgaaatttccaaaatctatccacgtcctcatcacctccatggccaccacctgaccctgccaccacagtttcctccttgttgccctgtttttgcttttgcccccaagatcctgtccctcctctgctcagaactctcccaggcccccatctcgcccagagaaaaatcccaagtcctcatttatgaggacccacaaggccctcagtgacctcttccctcggtctcacgccccctccctcactctgcttcagctgtgtgatccaactctactctgcaagatccaaccccagggcctttgcacttgctgtttcccttatttggaatcttctatccccatatcttctccaagtctctgaatctagctttcttatcatccagggctcatctcaaatatctcagggaggcctccctgaccaccccagctagagcagacccgaaagtctctctattcacagccctgtttcatactctacatatcatcatctaaaatcaccttgtatatgtttccttgactctctgccccctgtcctcctgaccccccaaatggtaatcgacacaacacagaatctttgaggtctacggtaagtactcaaaggattttttttaagaggtggaatctcactatgttgcccaggctggtctcaaactcctgggctcaagcaatcctcttgcctcaccctcctgactagctgggactacaggtgcacactaccatgcccagtgtctcaatggaacttctaaacaattcttcaaaataactggtctgcacacttcaaaaaatgtaaatgtaatgagaaacaatgaaacgcacagaaaccgtgccagattaaagaaaatgggtcgggtgcagtggctcatgcctgtaatctcagcaccttgggaggctgaggctggtggatcacgaggttaaaagatcaaaaccatcctggccaacatggtgaactcccatctgtactaaaaatacaaaaaattagctggacgtggtggcatgcgcctgtagtcccagctattcaggaggctgaggcaggagaatcgcttgaactcagcaggcagaggttgccgtgagccgagattatgccactgcactccagcctggcgacagagcaagactccatctcaaaaaaataaaaaaattaaaagaaaagaaaacagaagagtcagaatgactaaatgcaacgtgtgattctggattggatgctggaccaagatgaaccaaaaaggacattattgagacaactggcaaaactggaatacagattgtttattagataatgatcatgtatttgggctcattatcctgaaattggttattgtactgtggtcatgcaggagatgttcttgcttacactcaagcaattagggataaaaaagcatgatatctgcaacttattcccaaattatttcaataaaataatcccagtggggaaaagagagcataagagagagagagacagagagagagaaagcaaaggtggtaaaatgtttaaaactggggaatcaaggtgaggcatatataggagttcattaaactatttattaaacttttctataaatttaacatttttccaaattaaaaaaaaacaaaaacaaaaaacaaaaaacaaaaagaagctgggcgtggtggctcacactgtaatcccagcacttccagaggccgaggcaggcagatcacttgaggtcaagtttgagaccagcctggccccatttctactaaaaatacaaaaattagccaggcatggtggcaggcaactgtggtcccagctactcgggaggctgaggcatgagaatcacttgaacctgggaggcggaggttgcagtgagctgagatcgagccactgcactccagcctgggcaacagagcgagactctgtctcaaaagaaaaaaaaagaaaagaataccgaatgaatgtttctgttcgtgatgctatttgacagtaaaggaagtcagggaactggtttgggcagtgggtatgtgtgcacacacccacactcacatcagcacacactcacaaatgcacacctacatacacatgcacacacaggcatagtcatgtgcacacctgcacaggtgcacagacatgcacacacacatgcgttcatatcgcaaccacacatgcacacctgcacacacccacttgcacattcacacccacctgtgtggcccacagctgcagcaccagggcccgtgcctgcatctcctctgacacacccatctcctccaggtgcagcaggtaactctccagccatttgctccggtgggcccgcctggccagcctggctggggatagcagcttccacaggcgacttttgacactgcacatgtggtccttgtcccctgcagggacagagcacagagagtaggggttacagattcaccatcccacacccagggctggccaggcatgacctcccatgaggccaagggtcttctgaatgtcactcattgagggtggggagttcctgtgggaaagaagctgcaggacaggcccacagcaggaagccctttcaataccaaattgcttattatctgtcttacccccagtaaaaagaagcaaggggtcttgtctcctgcaggtgggagcctgatctatttcaatcacctctatgtccccatcacccggcccgtagcaggtgctcaataaatatgcattgtattagtctgttttcatgctgctgacaaagacatacttgagactgggtaatttatttatttatttattttttaaaaaataggtttaatggactcacagttccatgtggctggggaggcctcataatcatagtggaaggtgaaaggcacatcttacatggcggcaagcaagagaaaatgaaagccaagcaaaaggagaaaccacttacaaaatcatcagatctcatgagacttattcactacaaggagaacagtatgggggaaaccacccccatgattcagttatctcccactgggtccctcccacaacacatgagaattatgggagctacagttcaagatgagatttgggtggggacacagcaaaactatatcatgcattaaataaatggtagttctttccagagcaggagaaggaacactaaacactgagcagcattctccctccccagggtccaaccccagagcaatgccagcccatgtgcatgaggaggaggccactgtgagcaggctcagcacagcagcaatcacagaaagacatcagcaacaacctaactggcagattgggctggagtctcaaactcaactcactccagagaaggcaggccaagtaaaagagagacgggccagaaaggggccatggcacttagcccaccaaccagccctcggcaggagagggaaacaccccagcatggccagaaggcctgtgctttcaaaggaagctgataatccagacaattatgtataaccttctgatgttttttaaggttagcatccaagtaaaaagtttttaatcactgtgcagaccacagaagcatctctgaaggtcaactttggcccacagatcactagcgtgcatcaccattaaacagacaatggtgtgtttatgttctggaaacatacagcagtgaaagtgagttagtacattttacctacagacacagagagttcccaagggcagactggtaaggggataaagccgggcactgaagaatgacactatttagatattgttttcttttctacttctttttttttttttaaaatattttcatgaaccatacatgagccttaatatacattgttttaaagctccacggtaatgctatttatatgcacaaatataaagtttaaaacaaaaatataaaatataaaatttggttttctccgaaatcaccccttggaaaagtgagagtcattttggattgctctgaagtttcaaagtattggaaactccctcactgactcttctgaaccacaagccgtgtttcaggaagactcgccccaccagcgattctaaacctggctgcacctcacagggcatttgaaagggtcgaaaatgtagactatgttttttttttaaagtatgttggcttcattttcaaataatacgctgaatatgtttaacttttagacttcaacttgagctcattgttttacattgaaatgaatgtcaccatttcgggtgacatttcaatgtaaagcaataagcttaagtgttcaactgaaatacattatcttcctatgtttctccacttttcaggctctctgaagaattacctgggagctcttaaatctctggatgcccaggtgccaaccccagattgatcatgtcaaaatcacgtgcgtgggaactgggcatccagaggtttaggcctgcagggcgcgggcagtgttgaaaccacctcagttgatgccaactctggatacttctaagcatcatctgatgggatggctaaaaaaagaggcaaagaaatttaacacagctttagaaataactggcattctttgaagtctgaccacacaactgcaatcttgaatatcactgtaaacacggcgtttacagatgactttaaaaagcaaggcaggaccattctccacttttcccctgtgcctacagcagttctgagtacataggaggcactctatatttgcacaatcaatgaataattaagcaaaaaaggtaatgcagtatgaaaagacagctgacagaaagtgagaaaatatttgtaaataatatatctgataagggtctaacacccaaaatatataaaagaactcctacgactcaacaacaataaaaaacaaacaacctgatttgaaaattggcaaaggacttgaatagatatttctccaaagaagagatacaaatggctgataaacacatgaaacaatgctcaacaccattagtcattagaaaatgcatgtaaaaaccacagtgtgataccattcacaaccatgaggatggctactatttaaaacataggaaataagtgatggtgaggacgtggagaaattggaacccttatgcattgctggtgggaatgtaaaatactgcagttgctgtgaaaaagagtttagcagttcctcagaaagttaaagaattaccatatgatccagtaattctagttctaggtatatagcccaaagaactgaaaccagagactcaaacagatactcgtgcaccaatgttcatagcagcattattcacagtagccaaaaggcagaaacaacccaaatgtcggttgataggtgaatggataaatagaatgcagtatatacacacaatgtattcactcttaaaaaggaatgaaattctgacgcatatgccaggcatggtggctcacgcctgcaatcctagcaccttgggaggccaaggtgggcagatttcctgggctcaggagttagagaaccagcatgggcaacatggtgaaaccctgtctctactaaaatacaaaaaaaaaaaaaaaaaattagccaggcatggtggtgtgtacctgtaatcccagctactcaggaggctgaggcacaagaatagcttgaacccgggaggcggagattgtagtgagctgagatggcgacactgcactccagcctgggcgacagagactctgtctccaaaatctcatataatgagaatcctagaacaggaaattcagagacagaaagtacaatagaagtatactattcgacagaaagtagaatagaaagtagaatagaagagacagaaagtagaatagaagatatgtcgggctgggaggaaaggcaggtggggaattattgtttaatgggcacaaagcttttgtttagaatcatgaaaagtttctggaaatagataacggcatggttatacaacattgtgaatgtatttactgccactgaattatacaattaaaatggttaaaatagtatattttatgttatttattattttaccacaatttttttaaaaggcatatgaaggtcatttggcaaaaatgagtcaaagatagtgttgtataacaaagaatttgcattctgggcgggtgcagtggctcacgcatgtaatcccaacactttgggaggccaaggtgggcagatcacttgagttcaggagtttgaagccagcctgaccaacatggtgaaaccccgtctctactaaaaatacaaaaaaggataagctgggggtggtggcaggcacctgtaatcccagttacttgggaggctgaggcagcagaatcacttgaacccgggaggtggaggttgcagtgagctgagatggagccactgcactccagcctgggtgacagagtgatactcaaaatacaaaagaatttgaattccaaggtttcagttacccatggtcaaccatggtccaaaaatattaaatgaaaaattccggacataaacagtcataagttttaaattacatgctgttctgagtagtgtgttgaaatcttgtgccatcctgctctgtcctgcctggcaaaaaacacaggataaaaatatagcagtgggctgggtgcagtggctcactcctgtaatcccagcacttggggaggccgagacgggcagatcacctgaggtcaggagttcgagaccagcctggccaacatggtgaaaccccatctctaacaaaaatataaaaatacaaaaattagccaagcatggtggtgggcgcctgtagtcccagctactcaggaggctggggcaggagaatcgcttgaacccaggaggcagaggttgcagtgagcggagattgcaccactgcactccaggctggacaacagagcaagcaagactctgtctcaaaaacaaaaaaaatatatatatagcagtgattggatcatggatcaaatcagtttacatttgtatatcccttagagcagtgtagaggacacactaaaccttacccaagagttatctattgctgtgatatattgttagcacaaagcaaagtgccagcaaccacgtgtttagtatgcatttgtggaaaaaaagaaaaataagaatatagtcacattcacttgcacttgtgtgaaggaactctagaaggatccatttgaaactaataaaactaatcaattatgagcagtgggaattggtggaaggggatgtgacaagaaaaggaaggagacttaccactgttattacttaatttttttccagccttgctgaggtataattgacaaaggaaaattcttatttaagttgtacaacatgatgttttgatacacaaatatggtgtgaaatgattgctgcaatcaagctaattagcatatccatcaccttacataggtgcacactcacacgtgcatgcatggtgagaatacttaagatccactctcttagcaaatttcaagtatacaatacattgtatacttgtatattaaatctccagaacttattcattttataactcaaagtttataccctcaaccaacacacccccatttccccacctcctgagccctggtaaccactgttctactgttcctctgaattcaacttttttagctcccacgtataaatgacataatgcggtatttgattttctgtgtctggcttatttcacttacaatattgtcttccaagttcatctatattgttacaaatggcaggatttctccctttttatggctgaataacattctttcgtggatttacatacacagcagtcctgtcttatccagtttcactttccaaggtttccatcacccatagtcaaccatggtccaagaatattaaatgaaaaactccctaagtttgaaatcgcacaccattctgagtagcatgatgaactcttgtgccatcctgctccatcttgcctggggggtgaatcatccctctgtccggtgtatccacactgtagaccacacctgcccattagtcacttgggagccactgtctcagttatcacgtcaactgtcatggtatggtagtacttgtgttcaggtaacccttattttgttttcattacagtatatcgttataattggtttcattttattatgttgttaatctcttactgtgcctcatttataaattaaactttatcaggccaggcatggtggctcacgcctgtaatcccagcactttggaaggccgacgtgggcggatcacctgaggtcgggagttcgagtccagtatgaccaacacagagaaaccctgtctctactaaaaatacaaaattagctgggtgtggtggtgcatgcctgtaatcccagctactcaggaggctgaggcaggagaatcgcttgaatctggggggcggaggttgtggtgagccaagattgcaccattgcattccagcctgggagacaaaaacgaaactctgtctcaaaaaaaaaaaaaaaaaattaaactctgtcatagttatgtatgtataagacaaaacagtatatacagggttcagtaccacccatggttcctgacatccactgggggtcttggaacatatcccctgaggttaagagggggccattgtaccactatctctgtatctgttcatgcactgatggacacttagtttgtttccatgtctcagctgttgtgaataatgctgcaatgaattggaggtgcagacatctcttcaagacagtgatttcatttcctttgaatatatacctagaagagggattgctggatcatgtggtagctctatttttgattttttaggaacctccatactgttctccatgatggctataccaatttaaattcccaccaccagtgcgaaagagttctcttttctccacatccttgccaatatttgtcatcttttgacatttctaacgggtgtgtggtgatatctccttgtgattttgatttgcatttccccaatgagtagtgatgttgaacaccttttcatacctgttgccatttgtatgtcttctttgggaaaaatgcctattctggtcctttgtccattttgcagtcaggttatttggatttttgtgttttttgaggcagagtctcgctctgtcgccaggctggagtgcagtggcgtgatctcggctcactgcaacttccacctcccgggttcaagcaattctcctgcctcagcctcccgagtagctgagactacaggcgtgcaccaccacgcccagctaatttttgtattttttagtagagacagggtctcaccatattggccaggatggtctcgatctcttgacctcgtgatctgcccaactcggcctcccaaagtgttgggattacaggtgtgagccaccgctcccagatgttatttggaatttttggtattgagttgtatgagttccttatctattttggatgttaaccccatatcgggtatgtggtttgtaatctactttacatttttaatgtttaaaccacgcgaaataatttttaaaataaaataatagaaaatctggcaaaccccccaaaaataatttccagtgaaacatcatatactgtagagattcaaggaattcagtgcatatgggagtgaggaagagaagattctggaaaactgagcttggtggctcaacctggggccctgcagatgagcaaagctgtgtagttaaagggggagtctgcataaagccccctcctgaaatgtggtcgtgggaagaaagcaaatgttcgaaatggttacagcacatttatacaattcactacagacgttcaacaaaacagatacggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcccaggtaaagttccccgcccccacccggcgcgcccctcccactccgcccaccccagcccgctttggggcggggtggggggggtgggggatggggccctccgaggtccgcaggggtcggaccggggcgctctgttagaaaccctgctccccccagctcaggcctgatggaaaatgtgggagggaggggaggggagaaggagggggagggggagggggcggaagggatgtggtgggctggggagtgatcaaggggaaaggagatagatgggggactgagggggatgtggtggactggggggtgatggaagggaggggagagggagaggatttacaggaaggaagagattatatgcggggagggaagagggatggggaagatgggagaggacttttggggaagggaagaggagggaatgtgggaagacggcgggacgatggggaaacagccaaggaggtatggggaggagggggcacagtgggaggagaaaatgtggtgggaggggacgaacatggaggaggagtgtaagggggtcaggaggagctttcccaccacattccacattccacctagacagaggaaaccccccaaggctcctcctcaccccatcccccaccccaggcgtgctggggacctggagttttccattctgtggtctgggctgggagggctggtctggattatatcgcaccctatagtatcttcagtaactactgggcagggggtacaagggtgtctcagggagtcccctcatcctcacctgctttggggacagatagtgcccgtgaagtatgcaccctctacctggtgcacgttagggcctccggatgtggtggccattgtcatcgctacctggtgcttggggtgccagccccctgtgcccgcggctctgcaatgtaccaccccagggtgctgatgagaactgggggtcaatccagcctcactccacgcccctgcccccaccatccccattcccaccctgggaagcgttgggcaggtagctcaacctctctgagctcacctcattatctggaaacagggagggcagagttgtgcttacctctggggctgttgtgaggaagtgatgagagcttgacactaaaaggaatcacaaactgttgagtgcttggcacactaagttttatgaaaccatgggctgaacctggaggtaagacccaggaggtcttgttctagtcctgtatccacccattcagtgccgggtgagcttaggcacgtttcattccatagtcccagcagagctctggagaagctgttgctcctcctggtctcctggcttccatccttatcagccagggtcctgacaaggcccttcgagaaccagcatgatccgccccttctcacctttacctgcctgaccctatgcccccgactctctccctcacccactctgctccagccacactgatctccccatctttccctagaggtcccactgcagggcctttgcacgtgctgttccctctgttcggagcattcttcgcacagcctgctctttccaccacctccccggtgcctctatctctgctcagctgtcactgcagagaagctgtctttggccacctggtctaaaacagtcatctcctcttactgatttttgtttctttgtttttttgatagtttttttttctggcagtacttcacatgtcctgctatcatactcaagattcattcatttgcctgcttaatgttggctgtcgaggcagctggatgacccccttgtggcctcagcagattcagaacagcaggaggcaaaaggagttttctgatcctcttgtttatttttccagcttatctgccagagaagccaacaatcccaagaaggccatagaacgggtccagaggattttctccaaatttggggagctccaaagggctgtctgctagcagtggggttcacagctgggcttggccgatcctcagctttgtgaccccaagcagactgctccacctccctaagctgaggttcctcattgacagaatggggaaaagagaacctcatggagttgaggtcaggaacaaacgacctggtccatggggcacacctatgtgagtgcctgtcacaccatgagcatcagggaaagttaaccgcaattagcgcttataccagttccgctcctctccattatctgtgatcaggcttggtctcaattttcccatctgaaaaatgggaagaacagttccttcctcatggggctgctttgagaactgaattaaatgaaaagagaatgaaatcacccagcacagggtctggtatacaataggtactcaataaatattagttcttctactccccacccctggcttcagtgcagaccaatatcacctcaatacaaatatctcttccagatactctcttcccttctcgacccatagacaaaatcctcccagggaaggagaggcagctgctcacacaccaaagggagatgaatgtgagcctctggttcttcctggatttgttcaggagtcggcatatgtttaggaaggtggccaggcccccttcccagagaatgacccaccatgggtctgagctggtccaggaaatccacctttgctagtgatttgtcctgaggtgggcaccttccagatatctgttgcgggcttctagaaaaatgtgtttccttcctatttgccttctcttctgctttgggggcaatcgtgtgggaatgtgattagtgggggagctgaggggggctgtagtgttatgagggaaggccaagaaaactgcagagccccaaaccagagctgcggaatcaccatccctggaaccacctgcctatagatttctcatttaatgagctaaccacacgtctgtgctaggacaccatgagtcagatttttctaatacttgcagccaaagacattcccaactgagacgccttctagatatggctgaagggaggaccaaatgaggcaatgatgcatccggagcacctctgcaggactggcccatgcgagaattcaaaagtgttgctttgttttattatttttactttgcttactgtgtaagctttctatgtttatcaggctgacaggacatccaaccctctggctatggcatcttggaggaacaggcaggccttgaaaatagcagaaattccgaattcccctgccccgggaggactcaaaggaccctgctgaggacagagctgatatggcctcagaataaagatgagggaagaccatcccaaggaagacccctctagcccatggcaaaagggctggaatacgcaaggatttgaaaagcaagttttgctttccatataaacctaagcaagtcgcttaatctgtgagcctcaactactttacttgtgcaatgggcatgttgctggtagtggtgatagcagggagccaccgagagagcttccaagtgtgccatctaagccctcctctggggaagggaagctcctctggggaagggaaactggacccccgggaaaatttattctcccagggacgaacatccagacatttccctgtaggagcctcagtgtgttcagatgttcactgtccagtagaaacaagacatctaggcaactctcccatctcaccaagcctctgctctcttctgtggccactgtggggttgtgagagtaatgtcaagacccaacccaattagaacacagggaattttgcctgggaaagggagcccttctaccctacacccctgctttctctcttccaaggatcaggtctgattcatgtctgcatcctaaaggctacaaataaactgtgtccggaaaggaaaatattatgtgtattgccttcttcaaggctaaaaaccagtctcaacagagaggggcagttttaaatatttttttgtaacaatagttctaactttagttagtaactgaagccatctgaaacactttttcataataatttatttattccccacaaagaacctataaaatgggtagtaaaattattccgaattcacagatggtgaaatcaaggtccagaaagagtcacttcacccaaggtcacgtagtacttcctttgataagctagagcatgggaatttgatggcttcttaggacaagctaacttactccctggtgctgcaaacacaccctgggccttcccacctccacacctttgctcatgctgtttacctgcctggaagccctctctttctctaccttttgatttttccaaatcggttaggagcaggttctccaggagagccaagatgagatgagatatactaaaggcttattgagggagtgccagggagtaaaatgaagagggagccagagagggctgggagaaagggacagaaaggaggacaaatggaaggaagggacagaggaaagaagggaccgtgggctgcagtgcattcttagaaaggtcaagtctggccgggcacagtggctcatgtctgtaatcccagcactttgggaggctgaggtgggtggatcagttgaggtcagaagttcaagaccagcctgggcaacaaggtgaaaaccccgtctctattaaaaatacaaaaaattagccaggagtggtggctggcacctataatcccagctacttgggaggctgaggcaggagaattgcttgaacctaggaggcagagattagagtgagccgagaccgcaccactgcactccagcctgggtgacagagcgactctgtcaaaaagaaaaaagaaagaaagaaaaagaaagtaagtaagttagttcaaggctaacaggttgtccttgagcctcctgaggagccctatgtctcccaagaacaagtctgcttcccccagtgattggctaggagcaaaccctgggaagcatggcatatctgtcaatcaggctccaccaagggaggtcccagaggtgtgttttcatggctgctgcagctacgaaaggaagcacagctgccgtctaaaactggaacaatgcaagaataaattcttccacttacagaagctaaacgaggttgagaggtggaggggaaggagagacccaaaccgcaacgtttctggtgtttttgtgctgctaaagagagagtggtaaactcaagtcttcgagcaagtattgcaaatgaatgaagtgagccagtcatatcaggaaggcaacagggagggatgggaacaatggaaaactagagagggctgccccatccaaaaggaagcagcttctggcagtaccagccaactaaagccacgtagaaatacatgcctagtgtggccagatctttagactcaagagaagccagaaataatggctccaattattttaaaacgctgcatagaccaacagcacacacctgcccccagatttttagccctgcagtctagttgtgccaagggccagtggtttaaacatttggggtatgtaaaataggtttggagttgggatgttgaacaaaattgctctgtagaattaaggaaggacaacagagttttagggggcagcctgaaagagggggcaaagaccaggccgacatgagcacagattgggggcctgtcccagtgtgacatcctctgtggaattaggagccaataaatgaccatttctattggtgatgtgtcatactgagtgtttagttgtttgctgtcttgggctgtggaataacaccacacatacactcatatacatacacacgcacacacacacatgcactactctcacatacacactcacatgttgccccagttacccccaaacgttcagaaacaatctgctacacacgtcaagtgaccaacgcatcctggtttgcccagactttcccagttttagcactgagagccctgcatcctgggaaacctctcggtcctgggtaaaccaggaaggttggtcacgctatcaccacacctcagcgtagcgtgtgagtggccagagattgggtcagagctgtggcagccaccttggagcctgaggagaatctttgctaagtcacacaattaattagccacccctggaactgtgctgcagtagattagatcatagtctccaatttttacccactccctgtatcagaattagacattcacgcccttggctgcagggttgcggtgcctcccactatgagcagagaatagtatctccctgactcagtgatggtggactcgggcctgtgactcaatttgatcagtggaggatgaagaaatgaccagttgccagttctgagcagaggtttcacgaggaatcacatatttccacttgaccttggtttctgccttgagccatgacccacagggcaaacctgagctcaacctgcagcctgaagtagagaacccctagctgacctgcagaggtccgaagaagaaaaatgtacgtgttgttacaagtcatggagattttgagatcttcttaagcaacaagaattgactaatgtatactttatctctgaactttttagaatccttttggttgaatgttctttgtaccagttaaattagaataggctgctttctactcttggagccttggtacatctgtacaagaggatgatgacgacaaggcccccctcccatggtggttggacgaattcaagaagatcttgtgtctagtgcatgcagtaggcacttaataaaagagatgatgctaggccggctgcagtggctcacgcctgtaatcccaacactttgggaggctgaggcaggaggatcatgaggtcaggagttcgagaccagcctggttaacatggtgaaaccccgtctctactaaaaaatacaaaaattagctgggtgtagtaggggacacctgtaatcccagctactcaggaggctgaggccggaaaatcatgtgaaaccagaagggcgggggttgatcgcgccactgcacttcagcctgggcaaaagagtgaaactctgtctcaaaaaaaaaaaaaaaagaaaagaaagagagatgaagcaaggctgggctcagtggctcacgcctgtaatcccagcactttgggaggctgagatgggtggatcacttgaggtcaggagttcaagaccagcctggccaacgtggtgaaaccccgtctctactaaaaatacaaaaattagccaggaatgctggcgtgcgcctgtaattccagctactcaggaggctgaggtgggaggattgcttgaacccgggaggtagaggttgcagtgagccgagattgtgccactgcactccagcctgggcgacggagtgagaccctgtcttagcaacaacaacaacacagcagcagcagcaacagcaacaacaacaaaagagatgaagcataattctttcagcacatattaccaagtatttatttgccaacactgtgcaggcctctttatcaagaattttactgaagaaatgaaagacagaaaacctcttcacttggtcttttttatacatgaagagaaagcaggtctgaatcagaggcagagggttggaagaaatgacctgttttctgccatctgggccttgctgctgactgtctctaagaatttgcacaggcctgggcctttggagatttgaaggtctctaaagtgcaaggatgtcagctgcaggggagccatcctccagcatccttccccaggagagccaggattatgtagggaatgtgcttggctaagagcccagaggtggggcagctacccagatgcaaacatggctgggccaggcggcctttcgttcagcgttcccaggctaattccacctagaccttgtcttagcctgtgagaggatgttctggagtggtcttgcccctcttcccaggctatctgccagaggtggtgggtgctacaggagagggactccagcaagcttctcatcctttggttttcccaggacgggggacaggtggcctcacggctcccaaccagctgccttggcactttgtagtggaaaaaatgatgaagtcagacctcagtctcctcaactccctgctgtcctgcctgagagccagcctagcatggaaggcaaggagaaaagagacccatgttgatctgtcacccagacagaccctgagtgatgatgctcctgccaccctgaagcaccccaagaacctcagaacttctggcttctcatcttgaaaatgggacagcagtcatagctgctttgcttattatgtcaaggagttactaaagaggatccagttagatagtgggggtagaaaaatggctgcctaaggccacatttaccctctccttctagaaattataccagagcatcaagaataatggaaaaacaaatatacaaaaccaaaccacaaactccatttttagcaaagccaggagagacatataattcatcggcttcagagtacgtgtgaagcagctaagacagggcagaagccacatgggagtggtgagtgggctcagtgatagcaaatctcagaaagcatcagcaaaactacacttcctagggatgagggcttgccatgagatgaaagttatgttccttctttataaaaatgaatgtagaagcttgggtgaatacgattagcagcagaagctctcctggatctcgtttggttcagagaaacagaggaggtatagtgaagaattacagagagaagacatatttgcaggaagcagtctgtctctatggcagcagaggagagccacagttacagagcccatgaagctaccctaattcttccttacacccataggagcaatcagcaaaatacctgacccaggaaaaccaagcccttccaatgacaagcttttgaaaaagtgtaaaagccttgatacaaagatattatgataaattatgaagagcagaaaaatctaccaatagatgaaagtgttaacacaaaatggatgaaaattatatccaaatcatattggcataaattcaaaaaagaattgaatggaggctgggtgtggtggctcacgcctgtaatcccagcactttgggaggccgaggcaggtggatcacctgaggtcaggagttcaaggccagcctggtcaacatgatactctcgaggctgaggcaggagatcgcttgaatgtgggaggcagaggttgcagtgagctgagatcatgacattgcactccagcctgggcaactagtgaaactccgtctcaaatttaaagaaagaaagaaagaaacatcttaggagaactgaatggagcaactacctctgtgaaggaggacaataaggaaactgaagaactcaaaaagaaggcaggcaaaaggaggtaatgaacatgaagggttagcactcaggaaagaagtagaaagaaaaaaaaatatcagaaatgaagacaaaattggaggggaaggaaataggccctgcagaaaatacagcaaggacacggttaacagaaatggaaaaagaggaaaaaaatgagacagaaataaagaaaacattagaaagactagaaagaaaattggctgggtgctgtggctcatgcctgtaatcccagcactttgggaggccaaggcaggcagatcacttgaagtcaggagttcaagaccaccctggccaacatagcaaaaccccatctctattaaaagtacaaaaattagccgggcatggtggcacacacctgtaatcccagctactcgggaggctgaggcacgagaatcacttgaaccccagagacagaagttgcagtgacctgagattgagccactgcactctagcctgggcgacagagcaaaactctgtctcaaaaaataaataaataaataaaaataaataaaggtgtgagcatccatgcaccagataacacagcaacagatagttacagagcaaggacattttaagtcacttctctcagctcttgaaataccaagggaaaaaaaaaaggaaatagaaagtcaaaataacatagtgaaccacaaacactggctacctagtaagccacaaagaacatggcaataatttttttaaaagcagaataaaagtacaatagtctcagatcgcaatgcaacaagcctgtgtgacctccattcctctccctcccaccccagcacctccccagagggcaataatcccccagccccacttcaccaggcatcagctcctgtgtctgttccatgttagatcatgttagatctcatcttggccagacacggtggctcacgcctgtaatcccagcactttcagaggccgaggcaggtggatcacctgaggtcaggagttcaagaccagcctggcctacatggtgaaaccccatctctactaaaagtacaaaaattagctgagcattgtggcaggcacctgtaatcccagctacttgggaggctgaggcaggagaatcgcttgaactgggaggcggaggttgtgagctaagatcgcgccactgaactccagcctgggcaacagagtgagatgctgtctaaaaaaaaatctcatctcaaacacacaaacatttcactgctttaaaaaaaaaaaaatagaaatctttggtggatgttcagccacgctcatggttcacagctccaaactctgatgcacaggcaatcacatagcccaaatgtctacatgtcctgcatgtccgcagagggctagagtgagagagcctgggctccacggccagactatgtgaactcaaagcctggcacccgcccccccacttaaaaggcctcaggcatattgcttatctgtgcctttgtttccccaggtgtcaaatggagttggttgtgaggatgaaaagagttaatctctggaagtatggaaagccttggataaatgtgggctattagcattattttcacagcctcccaacctccctccactaataccagacacgctggagagagttctctgtctccctaaccatttatttggtgatcagaaggaccttctgcctgtgatttctgacctggcaggatactgggggaccacttttgcctctgcctggagatagcatgtctgagaatgaaaccgacttacagggcagcagaaccaagagatagggaaatacagtttcttgagatatcatttgaacccccggattcagccatgcctgaagccagaatgctcctgaccacatgaaccattaaattatttttgtttgcttgtttcagccaatttgggttgagtttctttcacttgcaatagaagaaagttctccattctgaagctgaataaggtagtatgtgaagtacttgtttcatacctggtgcttaatggatgaaaccttattacattctcatttcgtaaaccttctccagggctttctgggaggcaaccagatatgaattagagtgacacagctttgcactccttgcccagcctggataagatgccccattcgcagcaagctctatgcagtcagggccagcttcatggacatgcaacctgggtgctcacataggcccctgcacccagaatggtctcatgctcggcttagcgctctcctgtcaccagcttgaaattcttaattatttttgaacaagggtccccatgattttactttactctggtacccacaaagtatatagctggtcttaataccagtatcatctccactttccaggtgaggaaactgaagctcaaagaggggaagcaagcagcccaaggtcacacagcaagaaaggggtggagctgggaatcaaattctgattctgaggcccaagttcataactgcgatgtgccagtgcctggacaattcctcatatgtggatggcacttcacagtttatactctagtgcatagcatttgaccctcataccagctttagaagcagaaattgtcatgctggcatcaggcagagtacttgggtttgttcaagcctcagaaaccaaccctggctaatttaagaaaaagaaaaggtggggacgaggtattggaaggaaaagttgaccagctgggacttggaaaggacaggaacaagcagctccgggaacgcggggagcaggagccaggggtgtggggagcaggaaccagtggccaggtcttcggggctccagctgtttccaatctcagcattccttccgcttcagtttctgattctcccacgagaaagtctgattggccatgtttgggtcatgtgcctgcccacagaccttgatggtcaaccaaacaaggtgggaaggatgatcccccaaaggcgggtcagaaagtggggtgggagggctgaaagctgggcagggacggctgtgtgcgcattttacagatgaggaatgggaagcccagacagaaggcaaggccacagaaccgggaatggtggagtctgggctccagtcagaggcccaggctgcctctcttcactcccaggactccaggctggcaggggaacaggagggcattgttctccctgttggagtgaatggccgcctcctgggaaacccaggacccagatggggtctccccagggcgcaggaaactgcctcagactgagctgtattcaggggtcgaagcctcctccccaccctccccctacagtggacagactcccccttcaaatccaacctcactgctcagctctagccctatggtttttaagagaagctagtgggggaaaggcttatttttccaatgtgcattttttccggtatgtaagatactgtgtggaccaaataaaatatgtccagacctggaaacagcccaagcatagctagtttataagtcctggaatgctccttcctgcacacaaaaattaagggtctgtttacatagatatgctagtgtgttggagttgaacttttccttactctgaactcagatatgcaaagaaaaatgagccttttacattttccatggatgtcatctagttcagtgattaggagcaagagacatgctggagccagagaacctgggtttacatcttggctttgccactatgtgacctcaggcaggtcacttaacttctctgagtctcagtttcctttaagggacatatgtacacacgggtgtggcatttaataaaaaccacaaaagtccctgctactgctctgtgtccatggtatgatgttggtcatgagccctcacactggaagaaatacaaaatcttaagccaggctaatcatttaaactgtctatttaggcaagacaggcttcccctggggtatttcagggacaaactccattgatcagtttcccaccttcctctgctcctcttcaagaagcttctgcctgaacaccactttggtaacagggaaactgagctccgaggagagaggtcaaggttaggaaatgtcatttagtgagtgtcccttctgcacaaagccgtataggtacgcaagctccttgaatcctcataaccattctggatggaaagaatcaggactcccttaaccaacattgtggagcttgcaagtaacggaggcagcattagattccaggatgttcaacttcgaggcctgccttttctctgctcctattaactgtgtattcccattcctggtcataaggcaagattcagaggcatctgtgctccaattgaccatggcgcttgatcccaaaaggaaaaactctttctctctctctctacctgattaacaataataataacaataatttaatggctcaagcagggaaagtccagtggtgggaaatcctggcttcagggaactgggaagaaaaacagcttcaggaatggcaggatccaggggctccatggatgttgccaggactcacttctctctctaagcaatgctttcctttgtattggcttctccctcaggcagcctctccctgttttgtatcaagatagccttagcagtccttatgccctggcagcttggtgatgccagcagaaggagactctgggactaactctggttggccttattaaggtcagatgcaaatccctttacttctttctctagctcatatcggtcaggcctgcgtcgccttcccacttctagatctggaggtagagactagggtagttttctcacattgatgccctaattaatgaccttcctgcatccgagccctttgcagtgtgagtttatttccacatgatctgaatctgggcttggccttgagacttgctctgaccactggaatccaagggaagtgatgctgtgcctgcttccaacctaggcttcaagagtcttcttcacttctcccctctctgttggaactctggatagccaccatgagaacaaacctgggctagccagctgcaggaggagaaaccatcttaagaagtgcctggtcccccagcaaagactaacagcgcaacagccagctgacctatcagagtttgttttttaagcaatcttatctaccttcttgcaggactaggattgacagatgacaaaaaaaaaaaaaaaaaaagagttaaggcacatctgtaaagctagaaattggaaggctgctagggtttgaatcctggcatggccattccctagctattaggcttagtttcctgtggctgttataacaaattgccacaaactcgatggctcaaaacaacagaagtttattctcacacagttctggaggccagagggtgagcatcagtttcactcagctgaagtcaaggtgtcagcagggccatgctcccacagaggctctgggggacaaatcactccatacctcttccagctgctggtggctgccagcattcctttgcttgtagccacatcactgccatctctgccttggtcttcacgttgtcttcttttctgtgtgtctgtccaccctcccttggtcttcctcttacgaagcatatgacatgcatgcttttaatacatgtgataacatttagagcccagcaagataatcccagataatatcctcatcacaaaatccttaatttgatcatatttgcaaagactttaccatataaggtaacattcacaggctcctgggattaggagaacctgatttcttagaggtccaccattcagcccactgtactagcatgtggctccaagtgagtgtcaacctcactgtgcctcagtttccttatctgtaaaatgacagcagccacctcactgggtaattatgaagatttaataagtacttagaatggtgaccagcacatgataaaagctttgtaaatgttaaccttcaataatatcaagggtcggtcgggcgcggtggctcacacctgtaattctagcactttgggaggcagaggcgggaagatcgcttgagcccaggaatttgagaccagcctgggcaacatgacaaaacccagtctctacaaaaacaaaaacaaaaacaaaaaacctagccaggcgtggtggcatgtgcctgtagtcccagctacttgagggggctgaggcacaagaatctcttgaaccctggaggttgaggctgcagtgagctgagtttgcaccactgcattccagcctggggggcagagagagactctgtctctaaaaaaataataataataagatttgactgtgactgaaattcgcacaagaacaaatcccttctctgtcctgtttgctcgcgcctgtcttcatagcacccaccatggagacttgcacatagtaggtgctcagtaaatattaaatgcacacatgccactatgtagctgtgtggcttcaagcaagttgtttctcctctctggtcctcagtttccttctcccttcacgaagagcttcttgtagggaaagtccattcctctttctgggagggtgtgtccccatcaggggtagagggttcaggggtcaggagccggccacagctgctatctccctgagtcaccaaatttctcaacttgaggccaagtgtctaaatattgtgactgagccagttagagataagatgtggaaacattgatttggcccaagcaactgcagtcacggtgctggagccagacctccctggatcttctcagcagcatgagtgagtgtttagcacctgccaggaacacaggctgctgacctgcaaacagatggggaggcccagatgcctggcttggcagcaagagcctgcctttgccgtctctgtttacacagccagcatccagtcaaatctctgtggctccagtggagaaactaaggcccaaagggagtgaaggatgtgtcgtccagggttacgctgggagactgctatcccatgaagctaaaacccgcaagtcctaactcccagcccagcacctgtgggaacccaccaggcccagggagaaggaaggctggcagcgtgtcacaggcagggagcgtgcctgagcaaatgctcaggggtgaaagaccagatgcaagctcaaacactagagtgaatgggagaaaaggccacgtgtccaggactttggactcaattcagagaataaaagggaaccatcgatggttttaggaagaagagcagcaggatctgagaggctttttccaagtgcttatagaccaccagcatcagaatcgcctacgacaggagctgggggaggttgtcaaaatgtgggttcctggggtccaccctagatgtggctccccattgtagcaggccccctctgaggggattctgaagcacacccactgttttagtgagtaggagatgcagctaacatcccacttataaggtctaatctcagacaaacctggtttcaaatcccagctctgccacttacttgctctgtgattttaggtcacttacgacacctctctgagcctgttttctctcctccgtaatgaaacaatcttagcatttgcctcaaaggtttgttctaaggattcaataagataatgtaggtaaagtgctctacatagatccagagccctcctagtgctcaaaaacactggtttttagagattcccttgggcagcagtggggagaaagcaatggaggagggcaggcaaggaggcagggaagccagtgaggaggcagcagtgggactccggggagaggtctgtggctagggtgtggacatggtgacgggtggggtggctcctttgcaccgtgccaggtggtgccgatcttgtatgctcgattgcgaaagaagctctctggagttggtctagggcaggagagaagaggatgagcaaaaaaaccaaaagaggttgatcataaaacccatattcgcagtcacggactgggtgcttagcgtgggccaggccccgtgttagctgcttcctgatcttcatcctcacaaccacctgacagtgtgggtagcacttcatcaggggttgttaaccccgacactagtgacacttgtactggataattccttaattaaggggctgtgctgtgcactgtcaaatatttaacaacacccctggactctacccactagatgccattaacactcccaccttccagttatgacaaccaaaactgtctccagacattaccagaggtttcccgggaggcaaaatcacccctagttaagaaccagtgctttattctccttttacaaggagggaattgaaggctcagagagccaaagccctttgcccacagtctcccagctaagaagtggccggatttgaactcaggtctgactcggagccccggatgttaacctttgccgtgaaggaggccacatctatgcagtggcaggcccagatggtctatatgggggtcttggggacagtggtcttttccgaaggggcagctggaaacacctgctaagcagatgggctgcgtgagcgtttgttgggggtggttgtagaagcgatgatggggattatgagagagccaaatccccctccagaggctaccaccatttgccctggacagagggactgagggagatgggacgtggagggcaggcaagaaggaccaaggtggcactgttaggagaagctgggtgaggtcatctatgcctggagccccactgccgggagcctcccaaaaacactctccaagacctttgggctaaatatttatcctgtgaatgctcttttccttcctgcatggggagtggggctttggaggtgggtccaagaaatttggggagacagaatccagagaaagaggaaggggacaggccagaggtcagaggtcaggagaaagtagtcagaggccaggaataaacattcatcctggcatctaaagccttccagagtgagctccactgccaccacagccatctcactcagggaggcgtagaattcaaaatatgtttttgttttcttaagagacatggggaataaaattacaattttttttttggtccagtctttttttttttttcttttttgagacagagtctcactctgttgcctaagatggagtgcagtggcgcgatctcagctcactgcaacctccgcctcctgggttcaagcaattcttgtgcctcggtctcctcagtagctgggattacagccacccaccaccatgcctggctaatttttgtatttttagtagagacaagatttcatcatgttggccaggctggtctttaactcctgacctcgaatgatctgcccacctcggtctcccaaagtgctgggattacaggcatgaaccaccatgcccggctcagtcttgatatttttaagcaagggagttggaggtgaagggaaaattaagtcaaaaaatcttacccagaggacaggtgtggtagctcacacctataatcccagcactttgggaggccaaggcgggcagattgccagaggtcaggtgttcgagaccagcctggccgacatagtgaaaccccatcactactaaaaatataaaaattagccgggtgtggtggcgggtatctgtaatcccagctactcaggaggctgaggcaggagaattgcttgaacccgggaggtggaggctgcagtgagccgagattgagccactgtactccagcctgggtgacagagcgagactctgtttaaaaaaaaaaaaaggctgggcgcagtggctcatgcctgtaatcccagcactttgggagcctgaggagggcggatcaggagtttgagaccagcctggacaacatggtgaaaacttctctctactaaaaatacaaaactaggcggatgtagtggcgcacacctgtagtcccggctactcaggaggctgagacaggagaatcgcttgaacctgggaggcagaggctgcagtgagtcaagattgcaccactgcactccagcctgggcaacaagagcaaaactctgtttcaaaaaaaaaaaatcttatccagagaagaagtcatttttttagacacaagaatactttgtttatacagatggttgctataaaaggcctgactttgtgccgatagagaagatggatttatggtgaaggcagctcctgaatgagctcagtaatcaaagtcaaggtcctgccaggttaagctgcagcaggctccgctccctaccaaaaatgacaggctctgctccatctgatgggttctgctccagatgatggaactcataagggcatcatgctgtcaaacggttttactgccaagactgttgttcatgtgtccaaagcatcacgtctaacctctaggttacgatgaccccagagcttgcaaatcttggtggaagaattgcacggagcctgaagtatgtttttcatcggaaatggtgctcattaaagaaatacgtgcctgttagccatcacttggattgtacatgacatcgttgatgttgcgtgtgtgtgtgtgtgtgtgtgtgggtgcacgcacgcacttgtgtgtttacattttcttttccttctttgttcctccactaaagcagaaaaagtgttagaagatgtttaagagagatgtggaaacagagagaaatgcagttttatccactcttctctcttgtaagataaaaaatgtgtctctgggcagggcgcggtggctcacgcctgtaatcccagcactttgggaggctgaggtgggcgaatcatgaggtcaggagatcgagaccatcctggctaacacggtgaaattaaaccccatctctactaaaaatacaaaggattagccaggcgtggtggcgggcgcctgtagtcccagctactcgggaggctgaggcaggagaaaggctgaacccaggaggcagagcttgcagtgagccgagatccgcactctagcccgggcgacagagcaagactccatctcaaaaaaaaaaaaaaaaaaagtgtctctgggtgtttttaagccaaaagccattcttcaccaggagggcttgtgggaaagcagattctgactcagtaggtctggggtgaagcctgggatgctacttctccaatgcactcccaggcaacgcagcagccgccagtctgggagccatgcctgggagtggtggggccttagcacacagtgtgtgtccctgcctctggacacctcctgccatccctgctcttccctcccgctgctaagtctcgccctggtctccctgccttcttagagatggcgcttcctttagcaagtgtttgctccacttaaggattcagggaacatccgggctggagagatgctggagaccatcccgtccaactctcttcagttcccagttgcttttgtggcaagagctaaaaacccaactcaacccacacacgtttatatagacttgtggaaaatacaaagggctttttttttttggtgcgttttaaaatataaatggtatcatattgtgtgcgtcattctgtgcctgtttttctctcttagtaaccaatcttggaggttttttaggtcagcagagaaaaacctccccattaacagcagtacaacattccaggatctaaacaacagccttgacattactgacatttacggctggacaattctttgctaaggggctgtcctatgcattatagaatggttagcaacatcccaccggcatgattccagtagcacccctcgcccccatcagttgtgacaaccaaaatgtcatcagacattgctaaatgtgtcctgagaggcaaagctgccctggttgagaaccatggggataagatgtagaagagcaaattccaaagaggtaagatgagttacttcctggggcacaaggaaggactggaatggggatagagagttctcattctttatgacttcattcattcatccatttcatacatatttattaagcacctgccatgttccagacaccatgccaggtgctagggaggcagcagggaagaaaacaagccaataccttcctattgtggctctgccattctccctggggagacagacatgaaacaaacaaggaagacatcagtacggaagatgtgctaaaaactatgggagaaagtaggacaaggggagctgggagtgctggggcccaggtggggacttcagagcctcacatatgatgttttaatgtattaaaaggagaatatctccatgagttatttggatgatttaaaatttttttattacttgagcctaggagttcaagaccagcctgggcaacacagcaagacctttctctgcaaaaatttttttttaattagccagatgtggtggtgcacatctgtagttccaggtacatgggaggctgaggtgggaggatcacttgagcctgggaggtggaggctgcagtgagccatgatggtgccactgcactccagcctgggcgacagagagagaccttatctcaaaaaatattttttttttaagatggatgggctaagccagtcccagcctggctccctgaagcaaggagatctttcaaggggctgaacccgggtgcctgggcagcagctggcctcagccccccattccttccttcaaatccccttgcttaggacaataaactcctcaacaggtaccctcagctgcacttgcatggagctgcaccgccatcccaagagctcgtggtgggcctttgaggcaccctttctccatctgtgtgggttcctccagcccattgttaaaagatagtagtaatgtctaacatccctgtaaaaaaataatccccatgtttctcgaggccctaggtttctggtccctgctccctctctgactttttctcctcccactctcccccaactcactcagctccagccacactgactttctttctgctcctcaaacgttcaggctgggtcctgccactgggcctttgcacttgctgttcctaatgccaagtctttccccatggtctccccacagccagcttcttatcaaccaagtcccagctgacatgtcgcctccgcagagaggacatccccgaccaccccagccaaaggaggccttttctccaaatctccttacacgtctctctcacatgtgtgtttctgttacagtttgaatctgtgtccctgcccgaatctcctgttcaaccgtaatccccaatgttggagatggggcctggtgggaggtgattggatcatgagggcggtttctcatggtttcacaccatcccccttggagctgtcatcccaatagtgaattctcatgcgatctgcttgtttgaaagtgtgcggcacttcccctctctctttcttcctcctgcaccagccatgtgaagatgcctgtttccccttcaacttccgccatgagtaaaagctccccgaggcctcccaggaagcagatgccaccatgcttcctgtagagccagcagagctatgagccaattatacctcttctctttataaatgacccagcctcaggtatttctttatagcagtgtgagaacagactcatagtttccttcattgtacttgtgacttgatgaaatgattctgtttgattctttgccgggttgttgtcagctccataagaagaggactttatcttgttctctgtgtacaaacacatagtaggtgctctgtaagtacttgttgaacaaacatgtaaatgaatgaatgaatgagagccagtgtgatttggatgactgcgtgcatgtgctaagtaaactgttttccatgatctctggggttgtgtgtgtgtgtgtgtgtgtgtgtgtgtgttcagtttggtttttgccacatctttataccctctgttctattacaacttagcatttttctttttatataaagaaactcatttaaaggaatcttgacaatatcactagaaacagaaagccagtatcagcacatacttgctataaatagcaaaaaaaaaaaaaaaaaaaaaaaaagaaaagaaagaaagagagagagagaaagaaaggaaaaccctatgcatataaattccatgaagatgtgaaaaagttatcaaattctcacagggtatgattgctactgtagtttctaagcctgaggctttagaaaatcgatactctcttgaaaaaaaaaatttaagcctgaggctgttgtgtctttcttaaaaaggagattggcaggtgtcagagaggtgttcaagacaagttaactccaacccgaggctttctcaatgatctttctccaattcatcccaacacccacttgccgcagaccctgtggaaggccccagatccaaactcccttcctgctaacagcagctgtctggggagatttccttccagttgagccatccaaggactcctccccagcccttatctgtggaatggaaaaaatactagcccacacctcatagattaagagaatcaaatgagctcatttatagaaagcacatggaacaatgacaagcatgaaataatagtcactgatgtttactgagactaacagcatgtcacacccagtgcaaaatgcctcacgtcctcccacagagtcttcataacaacctttagctcatggaagtactatttttaccctatttggccaatgaaaaagcagaggcccaggaaggtgaagtaacttgtccaaggtcacacagcaaggaggcaatagagctgggatttgaaccccggctgcctgactccagagctgtacaaagccagataccacagaggctgggttattgttcgtccagacccatgttcccacaggtcctctcatcccttacctgctccctttctaccttgtatttctatcctcctgctctgaggagattcctctccctgaagatgcttgggcttgagggaaccaggaggagaggaggtgaagttggcctggatgactctgtggtcaggatcctaatgacccagtaattttcctccaagtccagtattctcaggattaagtcctaatcatccatctacccactcacccactcattcatccatctgtccatccatctatccatccatccattcatccactcacccatccattcatttacttattcatctattctcccattcacccatccatccacccacccacccacacatccacttatttacccacccatttcatccattcttccatccacccatctatccatctatctatccactcacctgtctatcaatccatccatccatttatccagccatccattcacccacccacccattcatctgtcctcaatccactcacccatccactcatttactcactcattcatctattctcccatccaccctttcatccactcacccaccatccatccatccatccatctacccatgcatccatccatccacccatccatccatccatccacccatctactcattgacccactcatttcacctattcttccatccacctatgtattcatccacccactcacccatctactcattcactcacccattcatctattctcccatctacccccattcatccaccagtccatccatccatccatgtaacatttactgaaggctcactacctgcctgcaaggttcaggtgagggacagagcaggactgtacaggtgtctctcagcctctaccctccctcattcctgcttccatcttcttctgatctgggataattcctctcctgggagatccaaggatgatggggagcaaaaggcggtggggtgaggggttggggcttcggcactgcctctctactgaggccccagtcccttctctgtatggacaaaatggaaacttgtggtttttcttcctgcattgaaccagcaggctgagctggggctgaactcctgggacattaaaagggggtgagaggtgaagatgcatccaggtggggggtgtgtgtgtgtgtgtgtgtgtgtgtgtgtgtgtgtgtgagagagagagagagagagagagagagagagagagaggaggtggagggcgaaaggcctgtgcatctctgtctctgtcaggcacacagagaatggcagtggtgagcctgcaatgtattgggaagacattattgtttgctcagaaatggccaagaaccccagctcctccctgccaggagacacaggattctgcgcctccaggcacaaccgtcttccctcccttccactttcctccctcctcctcaaacccttgcccaggtgccccccggctggctgggttcaccagaggatagatgaccacatactaatcccagcctcctgtggaggttagtcccaccctccaccgaggtggaaaattcctgcaggtagagtcagcagtggttcaagtcccaccgttgtccatgagatcggactacacagcacacacggccgcttttttttacctaccacgtgtcccacgtctcctacagtcctttaatccctgaccagtccttcagaggatggacacgctctgatctttgtagcctctctttctctcctcagggatcacacctcactgtagaccacagcccaatgtcccaggtgactcacttactagaatttgtaattcacttcatcctgccaccacgcccctgtgagctagacacccaaattgactccattttacagatttggagactgaggtgcagagagattaagtccctgtctgaggtcgcatggtggatgagcagcagacaccctggcgggcagcctggctcctgagccacgcgtcaccaccgtcttagtggaaaatcggccacaaggagggattccccttccagtctcctggcccttgccaaaggatccatactagacatgagaggaggaagggagtccacaccgagtctggcctcaaaccctcattccttaggaaactgcgctaatgtcgccccctccctccctgtgaccaccccaggttgtatctgcaccttcccagctagcccaggtgtcattacatatttatctgttgatcactcggctccagggactgccatatcggcccaggaagtcacgatcttgtctgtctggttaggggctgtggtctggcactgggcacatagtcagtattcaatgaattttggctaaagcccttttggatcgatcatctattgccagtgtggctcagatgcagcccccgccactgactgtgtgactctggcaggtcacaacccctctctgagcctcccttccatcatctgtaaaacagacttatctctgagtcctacacatgttaaacactcaaaggatttctgttgcatgaattagtgaaatccgagctggaagggcctctagagcccagggttgcaaactcatagactccaaaagccaggcaggagccagaaaccaccgagggagctgggtggggacggaggcagctgctactcagctctagtcacaagcactgccatatctggtttctcaagaaaaaccagaaatctagagatttacaagaagtttcccaatttctaagtattggcaactaatttaaaacatttaaacacatctgtggacgggatgtggctgcaggccgtttctttgcaactcatgattcatctaactgctcgtggcacagatgagatcaaagcccagagaaggtgagccaccagccccaggtcacagagcacaggaagtgaagaggaaacagtgacctttctccttcggctgcagccctgttgcccaagctcagggcaacccctgagccctgatcccaagggaggcagtgccgccttctcctctaggcctggcagttccagggtgacaggaaggtcacgatatctctgtttgggtgcactgcagcctccgcttcctgccaggaccaggctgtatcaggcactgggatgaagaaaacattccaagcaatgggctggcctagaaggtaagagctggtggcagagagggggtaagcacaccccttccttacttcagggacgtgcaaaccccttcagcaggcctgggcagagctgggaacagggcggatcaagccctgcttctggagaaacatgctctgccattggaggctgggagctctgtccccgcatggctcgtaggaccttggaatgcatttgtccagcagcttctaatacaccaggccctcatctgacccgcacccccacaacctccatgggctctcctccctctgtcccctcttgatctctctacgcaggcacaatggtgcctgctcagccctgaacacagcagccctgctcccacctcagggcctttgcacacgctattccctctgcctggttcacttcacccattatgcagatggcttactgtagacctctacttgaatgtcgccttctctgtgagaccctccctacctgttcactctgtttaaaaatgcaaacatcccccacagtccttagcctccatctggcttcctttgaccctgctgtgcttaggatggtgggacacatatgttacacgtgtttatttgtgtttccctttcctgttgctgctgtaacaaatcgccgtgaacttgggagctggaaataacatgaatgtgtgagcttacagttctggagggctgaagcccacagtgggtctcagcaggctaaaatcaaggtgtgggcaggaccacgttccttctagaggctcacagggagaatccgttcctccagcttctcaaggccacctgtattcctgggctcacggctccaacctccatcttcaaagccagcaacggcgaggccatctttcccatgctgcatccctccgcctgcaacacctctgcttccctcctgcactaagccccttgtgatgacactgggtcacgatgtcatcatctgggtaatccagggtcgtctcccccagctcaaggagactgctcagcagcctccattccccttggccgtgtaaccttgtacattcacgggttccagggatgaggacgtcttggggaagggcgcatgagtctgctgaccacacacaccaaacacaccaggcgttggctccaggaaggcacgtggtttgctgctttatgtatgtccaatgcctggtgcatagcaggtgctcagtagacccttggagactgcgtgggtgctggagtagaatgttgtggccgccaaagggaggcaggaaaggtgactcagctaccccagtggtcctccccgtcttactgatgaggagactcggggagagctgagatgctgagggctgaagagctgtgacttagcccctacccttccacacccatcctgtgcccacaaagaggggtgggccctgggctgtgtcggggagccccaaagagaaggcctgaagtccggcagctttaaaggggacagtcctggccatgagccctctctctgagcgcccctcacaacccctacaagctcccctcccaaggctaggccagcagtgcctgcagggggctgcccaggcgtggtcctgccatgtgggaactgcctgtgtggcccagcaggacccagatgagtcacaggaaagctggggtgccctccctccagccccacgtgtctccctggcttcaaaggaaaccgactgagggtccaagtttcctcatgactgaaaaatgttccaccccaaaaatgttccacatgagcaacagctcacccagaaagaaagagaaatgaagtaagtggcttttcagcatggggagagacacttggccatgcacagctacaggcagagatctgggaaacagaacgccggggaaagcaagtgaggaacaggagaactctgcaaatcagaacactcatcataaaataattctgcttgtttcacaaggacacatatacatccagggacatatatcatgggcctcggtatggaggctcaaggagaaaacaaaacaaaataatttattttgttttaaattattattattatttgagacggagtctcgctcttgttgcccaggctggagtgcaatggcctgatctcagctcactgcaacctcaacctcccgggttcaagcgattctcctgcctcagcctccccagtagctgggattacaggctcgcgccaccacgcctggctgatttttgtatttttagtagagatggagtttcaccatgttggccaggctggtcttgaactcccgacctcaggcgatccacccgcctcaacctcccaaagtgctgggattacaggcgtgagccactgcgcctggcctaaattattattatatgtttattttgttttaaattatttttatattttacaatggagcttcctgacatgtgacaatgatgctacggttttttgttgctgtttttttgtttgtttttgagatagagtctcactctgtcacccaggctggagtgcagtggcacaatctcggctcactgcagcctctacctcccacgttcaagagattctcctgcctcagactcccgagtagctgggagaacaggtgcccaccaccacgcctggctaattttttgtatttttagtagagacagggttttgccatgttggccaggctggtctcaaactcccgacctcaggtgatccgccacctcggcctcccaaagtgctgggattacaggcgtgagtcactgcgcctggccaatgacactatgcttcactgaacaagcaaaaggtactctgcttcactcttcatttaaaaatagaaactgaaaccatactgagacacctgcttccatctattagagtgacaaaaacatcagaaagttcacaatacatggtgctgatgaagttgtggggaaacaggcaccctcacacattgttggtgggagaataaattggtacaacctctacaaagtgcagtttggtcatatggatcaaaatgtaaaatgcacaaatctgttataaaatctgacttccagagatttctcccacagatacattcacacacacacacacacacacacacacacacacacacacacaccacactatgtacaaagacagtcaccacagtattgtttgtagttgttgttgttttgagacagggccttgctctgtcaggctggagtgcagtggcgcaatcacagctcacagcagccttaacctcctgggctcagtgaccctcccaccttagcctcctgagtagctggaaccacaggcacgcaccaccacaaccagcttgttatttcatttgtaaacatgaagtctctctatgttgctgtggctggtctcaagctcctgggctcaagcaatcctccagcctcagcctcccaaagtgctgggattataggcgtgagcttctgtgcctggtccacagtattgctttataacagaaaaggctggaaacaacctaaagggccatcagtaagaaaataactattaatgaatatggtccggccatgcagtggaatactatgcagctgtgaaaaaggacaacacaggtatgtgtgatgaattagaaagaatgataggtatgttaggttaaaaaaagcaagctgcaagacactgggtgtaacatgcatctatatatgtaaataaagagtgcatacaatcatgtgtgttttcgtacgtacagactttcagtggcagagcccgtgggaaactggaagcagcattgcttagggaaagtgaaacctgggggttaagggtggggagagacactcgttttcattggatacttttttctgtcattgaattttttcccatttaaatgtcttacctatgttttaaacataatttttaaaatataaaagcaatgctcacttgtcacaaaatctaagcaatgaaatgcaaatgatatgaaaccagttgtccctaaccactcccctgaaatcactactattaacatctttccagagttaacaaaaggtcttaagtttagatatgcttctttttttttttttttttttttttttgagacagagtctcactctgtcacccaggctggagtgcagtgaaacaatcttggctcactgcaacctctgcctcctgggttcaagcaattctctgcctcagcctcccgagtagctgggattacaggcgcccaccacaatgcccagctaatttttgtatttttagtagagacagggtttcaccatcttggccaggcaggtcttgaactcctgacctcgtgatccacccgccttggcctcccaaagtgctgggattacaggtgtaagccaccgcacccggcctagatatgcttctatattattcgaacttgtgcaacaggctgtgtgatttgaaattaaacacaagggccaggcacagtggctcatgcttggaatcccagcactttgggaggccaaggcaggtggatcgcttgagtctaggagttcaagaccagcccgggtgacatggcgaaaccccatctctaaaaataataaataaataaacaaatagatagatagataaataaaggaaattgaacacaaaacctcccttttgagtcaacgattatcaaggaggctgttatagttgcagaggtggcctggacagagtggtggccatagagacagagaagtggccagttgtaggagcaaatgtcacaggttcaactgacagggtcagacgcacaggcagggagaaacaggagggaggacatgccatgagctcccttgtctaggcccacactgaggtgacacggcccaagtgccccagcccgacagggtagactgcgatcagggtcaggaattcagtgaggcaggtcctggagcactgggagggggtacgagggtctcagatatctggggctgggactcttgaggtcatagcaagataagtggatgacatactcagtttcaagagttaaaccccagatttacatggctgcctggagtctggattcactggtgtgaaatttggagggagatgacgataataagaatactaatactaacagtaacaataactatcataagaacagaggccaacactctgtagcacttactacaggccaagtgctatatacgtgttaactcataatcccacaatcaccctctagatataggtgggtatagagaagcatgcccccatttcacagatgagaaaactgaggcccagagaggtgaagtaatttgcccacggtcacacagcttgtatgggatagagaagggcagggcgtatcactgaacaaaatggaggtcccttcaccccagagttgcaaacccagcctccctcactcccactacccctctgggcctcactgcatggatggacagtggcaacaacccctcctgggcctccctgactctaccctcgtcccccattccccacaacagtcccttctctatccagcggccagagcgatcttcctaaagttctagtctcatcttcccttggtctgctctcaggcagggccaggcattaggtgaggccagcaggtgccggcacaatgtcaggagacccccctcccaggtgagcccctgctctggcctgattcacagcgaggcctccttaggttttgaacactcagtgtccctcttgcacagatgggaacagacagtctctggaatccccccaaagccgcatttgaagtttctttccaggcagacaggccctttccaggcggatggctgcttcaatccagatgaggatggaggcctggggatctggcagctctgggctgatggcaccacgtccaggggagaggtttctgttttcctgcagtggttctctggcctatgcttgctggatgggggtgttggtaaatcctccagcttcctggggcctggggaggagcaaccctgaggtggactctgcacccactcccagaggccccagcaggacggagccccagctgcccaactgataacctgctcatctagacacccagcagtaccagctgccccctcccctctgctctcagagcttcctgcgatcagctccccgctaagttccctgcccttggactctctaagtgtctgcttctggaagaggcccaagccaagacctgggagacaggtcagtggctcagggctctgtggctcatgatatctgcagtattctctctgtggcctgggtcttcctgtcttctgggtgatccctcggcctttgggaggccgaggtggttggatcacctgaagtcaggagtttgagaccagccagcctgtccaacatggtgaaaccccgtctctactaaaaatacaaaattagccaggcatcatggggcacacctgtaatcccagctactcgggaggctgaggcaggagaatcgcttgaaccccggagggggaggttgcaatgagccaagatcacgccattacactccagcccgggcaacaagagtgaaactctgtctcaaaaaaaggaaaagaagagaaaagaaaagagagaagaaaagaaaagaaggcaaggaagttccatagcccatacagtgggtatcttaggcagggctctatcagatgaaaaatatagcagaaccctgactcaaattggctgatgtcatgagaatttacgtcaactgtctctggtaaaagcaggagtagagataggcttcaggcatggttggatccagatgctaaatcaatgtctacaaagatgcactacctctggctctcatctcttttactccacacagactctccaggtcatgatgtgaccaaggttgccccttgccactcccagctttattctcaccagctcagcaaccccagggaaaagggagcaccaatttccaattgtttcagaacaaggtcagtggcaatgttactcaaactcgaacgtgcccatgttcacactggggccctggggactatgataaaatgcagattctggctcataggtttggggtggggactcagatgctgcattcactgcattttttttaagatagagtcttgctctgttgcccaggctggagtacagtggcatgatcacagctcactgcaacctccactcctggcctcaagtaatcctcctgcctcagcctcccaagtaactgggacttcaggtgcatgccattatacccagttaatttttgtattttttgtagagacctggtcttactgtgtcacccaggctcgtcttgaactcctgaacccaagtgatccacccacctcggcctcccaaagtgctaagattacaggtgcgagccaccccgaccagcccagatgctgcatttctaacaagctcccaggtgctccttgtgctgctgatctggaaccatacgttgagtaggaaggtctttgcatgatgccattcctctcagctaaaagcacattgtaggccaggcatggtggttcacgcctataatcccagcactttgggaggccgaggcaggtggatcacctgaggtcaggagatcgagaccagcctggccaacatggcgaaactctgtctctactaaaaatacaaaaattagctgggcgtggtggcgggcgcctgtaattctagctactctggaggctgaggcagtagaatcacttgaacccgggaggcggaggttgcagtgggctgagattgcagcattgcactccagcctgggtgatgagagcaaacctccatctcaaaaaaaaaaaaaaaagcacattgtatacatatgcagaatattcatctaaagaaaaatcgtaatcaaaattaaaaagtaaaagcacattgtgcacacacaggaaactattgctgcatcccaagagtcccgcatgcagtagctcatcaactggtcacaaggacgttagaggtgggtgctctcattacctcatttctccacaaggcccagacacattcccaagcctgcacagctgggaagcagcgaagctgctttgaccccaagtaatgaattctccagatggaataaacaagggccctgctgatggcccttaatgctctttgcaatcctcctctattacaaaaccaccgtgctgagcaaccccacaggtgcgtgtgtttgtaagcatgcactagtaggtttggggaaagagattcctacaggcgaaattgctgtatcaaaagatgatgtatggttctattattgctaggggctgccaaaagggaaagagactgcccatttccccacatccatgccagaactgcatgttcttgtttttgccactctggggagaggcgcccttcctcatggccctaggaaggtagtgaagttatgtcccagccccaggtaggcagcctccttcctgcaaggggtcatccagggagcaccctgtgccagcccacctctgggcatcctgttgtcatggaaatatttcaaggcctgctttcatcctgaatagcaacttcagtggaaagagaaggcctctgttatgggctaaattgtggtccctcaaaattcatatgttgaagtcccaacccccaagacctgaaaatatgactgcatttagagatggggtctttaaagaggtggttacgtttaaatggttgttagggtgggccctaatccagtctgcccggtgtccttataagaagaacagacctcaggagcgcacatgcacagagggatgaccgtgtgcagaggcagcaagagggtcgccatctgcaggccaaagagagaggccttgacggaaatcaaccctgacagccggcatctcgagcttggacttccagcctccagcactgtgagataataactgtgttgcttaagccacccggtctgtggtcttttgctatggcagttctagcgaacaaatatagtctctttccctgcacacctagaagagttcctgggaagatgcccatatgcctggcttggttcacttcccgtctgttaccaattgctgtggccaccagatgctgaactctaatcggtcaggccttggccaagtgctcatccctggagctagggatgggctcagcctgccaacctgggttcacttttccttgtttgattaaaaattttaatttaaagcaagtgacggctggatgcaatggctcacttctataattccaaccttttgggaggccaaggtggaaggatcacttcagccccagagttcgagaccagcctgggcaacacagcgaaacctcaactctacaaaaaatatttaaaacttagccaggtgtggtggcacccacctgtggtcccagccacttgggaagctgaggtgggaagatcactcgagcctgggggatcaaagctgcagtgagctgtgattgcaccactgcactacagcctgggtaacagagcgagaccctgtctaaaaaaaaaaaagaagaaagtgaggtcgaacctgtggctaacaaggggataatttacatgtctgagctcaagttcagatgtacaagttggattctcttttcttttttggggggtggggacagagtctcactctgtcgcccaggctggagtgcagtggcgtgatctcggcttactgcaacctccgcctcccgggttcaagcgattctcctgcctcagcctcccgagtagctgggattataggcacccgccaccatgcccagctaatttttgtatttttggtagagatggggtttcaccatgttggccaggctggtcttgaactcctgacctcaagtggtccacccgcctcggcctcccaaagtgctggtattacagacgtgagccactgcacctggccatcaaaattagaagtctttttaaaagtccctttgatcccacccatggtaggcaaaccctacctcaggcatcgggtcaggctgcaatttccaactcatatctgcttttagcccctggagatttcacttaaatcctgtgagctcagccatctatccccaagatgcagttcctccaagatacctggcaggcaccctggcaggagggtgtcacggttctctaacctggctgactactgagcctctgggctccatgaggacaggatgtctctctcactcgctgctagcccagtccctggcacagccctggggcttggcaaatatttgttgaatgaataaacaggctgtggcttataagctggttcagattccagctccccactcactccgcatggaagaatcacttcaatcctccaagccccccgttcttcatctgcatgggggatattttgttgttattgttgttttttaaacttgggatttttttttttttgaaaaatagaacagatacagatacaaaaaccacacagcataagcatgtgacttaatgatttattataaggcaactgaacaccctcgtgaccacctctaggtcaagaaatgtaactttgcctgccacccctggaaacccctgcagaaccctgtcctctcaaagccctgcccctcccaaaagtcactgctaccctaagtgttatggatatcacttgtgtttctttcttgttttaccaaccatgtgagcagccccagacactatacttaatcttgcccactttttaaaaacttgatgtctcttttagtttctattcctcctccatccctttcttttccttacaatttacctgcgcagtacctgggccatttaacctgcagagatccctgggtctgggttaggctgatgacagcaccgtgtcatggttcaacacgttctgtccttgggattttctgtaaaacggcagctggatcctgaggctacaccagggatgtttccaagcttctgccctcacgggtcgtggtgagaattgaagggggatgggtgagtgtttgatatcagcgagcagcccccagaagcagccgccaaggctgttcggagatgctcacgaggcctgaacatggacagcccgagggacatcccatctcaacagtccatcctggcttctctccccacccagacccacccaccccactttgggaaagttctagggccatggctggctcatcccagcgagagctggcagcagaatggcctgtaattttagctgtttctcttccctaaaattatttcccatctggaaatggtttcccaaccctgcccaggaaagagttggtggtgcaaggaacatttttctattaaaaaaaaaaaataggggccgggcactgaggcaggagaatcgcttgaacccggcaggcggaggttgtggcgagccaagatcgtgccactgcactccagcctgggcaacagagcaaaactccgtctcaaataaatatataaaaccagccaccaaacactgaatctttgcagcccaggctctggaggcctggctgagtgccagctgtataccctgccttgagggaactctgtcagcgaggagcagagggtgagagggcatagtcagggctctgctgccaggatacccccacccacccagtacattcggacaaggactttgttgcagggcctgggacagccccaggcgagctgagaaggatccgacctggggttgagtggcctgcccagctgctgccacactcgaggtctgtgggttattctaggtcccacagggcatgaaatcacagagcagaagttcttcctatggggattctcttgcagctgctctgagcatttcaagaaaaaaaaaaaatccctgccgctaacatctccccatcacctcgctaattctcttctttctttcctttttttttttttttttttgagacggagtctcgctctgtggccaggctggagtgcaatggtgccatctcagctcactgtaacctctgactccctggttcaagcgattctcctgcctcagcctcctgagtagctgggattacaggtgcccgccaccacacccagctaatttttgtatttttagtagagacggggtttcaccatgttggccaggatggtcttgatctcctgacctcgtgatccgcccacctcggcctcccaaagtgctgggattacaggcttgagccgccgaactctcttctttctaacaaagttctcacaggcccctgactcctgactgtgcaagcaagagcatctggcaagaatatcatgatattttttagcacttcttgtacttattttcataattttttttttgagacagagtctcactctgtcaccctggcttgagtgcagtggcaccatctcagctcaacctgcaacctccgcctcctgggttcaagtgattctcctgcctcagcctccttagtagctgagattacaggtgtgcaccaccatgcctggctaatttttgtatttttagtagggacaaggtttcaccatattggccaggcagtcttgaacttctgacctcaggtgatctgcctgccttgacctcccaaagcgctgagattacaggcgtgagccgccatgtccagccttattttcttatttccttttttttttttttagacggaagctcactctgttgcccaggctggagtgcagtggcatgatctcggctcaccacaacctccgccttctgggttcaagcgattcttctgcctcagcctcccaagtagctgggactacaggcatgcgccaccatagctggctaatttttatatttttagtagagttggggtttcactatgttggccaggctggtctcgaactactgaccttgttatctgcccacctcagcctcccaaagtgctgggattacaggtgtgagccatcgtgcctggcacccagccttattttcataactgttttcatgataaatgatataggttttccatgtttgctaatgatataaagtttcctctgcagaaacaggtttaaagaaaaatgtgggcagaaagtccgtttaaaatatatattaaggaaaataaaacacagatagcacaaaatccaaagctacctggagttttggtgcctggagccatggtgaagagggcatactccagatctgagggcccaggcttgcattctggctgtgactctgtgggccctgtgattttaggcaagtcacttgccttctctgagtcatggtgctttacctgtaaaagaaaggaaaataataacacctccttcctatgatgatctctgagaattcaataaaacaatgctgagaagacactcagcccagtaccaggcacatgggttgcatttaattctgtcagaacacaaggtgggtgctatttttattcctgttgggaagctgaggcccagagaggtcatctagcccatccaaggttgcacagcttgtaggtggtggaggtggaactagaacccacaaagttctaatgtgagactgggatttgtgctcttaaaccactgtgctgctattggcagatccatctatccacccatccatctgtccgtccatccatccatccatccatccatccacccacccatccatccatccacccacccacccatacattcattcatttggtcagaattcatggaattgttctgagttcatggtgttttctcaaaaagcagcaaagtgcagaagttcccagagtaggttcaaatcccaacctgccatgtacaggacacctgggcaagttgtcccacctctccgagcctcagcttgcccatctggaagaggggaacattgatagccctttgaaattcccgcaggaggtagaagactgttttctgggacttcacagtgtcctacgtgccctgcatctgaccccatggtctgcgttcacctctaagtctcagtgaatcaagctccgccatatgtctgcctcatcctgcctccctcctccctttcactccaatttagccagactcagccattggggttccctgaacagcccctgggcctttgtacactttgttcctccagcccgaaatgtcctcttgcttccatctggtaaccatgattcctccctgaaaaatcaggtgggcttccccctctgccccaggagcatcccctgaggctgagccaagctctgcctttctgggctcccccagctccccgcttctctgacatggaaaggtcatggatgtaataacttagacaaactcttgtgctctgccactgtccaccttcttggtcacaaatgtctgcttcccttctttcatgcaggtacatgcacccctctgcaaacgagtccacacacatgtttttacacaatcatggcatgtgatccgaaggcatgagatctgccttcgtacatgcaacatgcaatggtggaacggcattacctctggctagtgacctctcctggactcagctatcacctctgcagaaagggggcagtaacaggacctgccgcacatctgctgtcatgaagaccacatgagctaatatatgtgggaagcccttagcacagcgcctgggagagcataagcgctcgatgcaaggcagaagaaaggcgtgtcctggtgtgacagggcccttccgaccagggctggtactaaggtgagaaaagcgaggtgcctaccgtgcaaaatgtaaggcagcgttcactctcagagcagtgcacctgccgctgggtcctcggagccacagagcagtcccgctcgccccctgctggtcactctgcagaatgacgtcccttccctctgctctcaggggtccctgagcctcggtttcttcacctgtaaggtggggtaggagaatctgcctctcagtttgcagggcaaacaggaggcactcctccaacatcagtgtcctcctctcaatgccagcacttaatgagcacctactatgtgcaaagaaagatgactgagacatgatccctacccttcaggggtttagcgagtggagaggggaggaggtaggctgggaacagtgactaaagtaagacacttgtccctatgcagcacctactgcttaccccagagcagtcagaaccactgccctggcatctgtccatctgcatatgtttactaagcacctactgtgtgcctgagcccaggctcagctgtggatttacatggattaaggggtttaatgctgtcagaacacaaggtgggtgttctttttattcctgttgggaagctgagggccagagaggtcatctagcccatccaagcttgcacagcttgtaggtggtggaggtggaaccagaacccccaaagttctaatgtgaggctgggatttgtgctcttaaaccgctatgctgctattggcagatccatccatccacccatccatccacctacccatccatctatccaaccatccatccatctatccatccatccccatccgtccatccacccacccatccattcattcaacaaatattcgttgagcacctactgagtgccagacacagtgctgagtgctggagagatgccagtgaccagaaagacacagcccatccctgcccccagcagctgttcacaaagagaggatgggcaataagcaagacaaataagtaaaatatatggcacttggtgattcttgctgtatataaaaatagagtaaaagctgtgcacggtggctcacacctgtaatcccagcactttgggaggctgaggcgggaggatcacctgatcccaggagtttggaaccagcctgggcaacatagcatagtacagaccctgtctctactaaaaacacaaaaaattagctgggcatggtggctcatgcctgtagtcccacctacttgggagactgaggtgggaggattgcctgagcctagtcgagatcgaggctgcagtgagccgtgattgtgtcactgaactccagtccaggtgacacagcgagaccctttctcaaaaaggctgggcgcggtggctcacgcctgtaatcccagcactttgggaggccgaggctggtgaatcacttgaggtcaggagtttgagaccagcctggccagcatggtgaaaccctgcctttactaaaaatacaaaaattagctgggcgtggtggcgtgcctctcaggtactcgggaggttgaggcacgagaatcgcttgaacctgggaggtggaggttgcagtgagccgagatcgcaccactgcactccagcctgggtgacagagcgagaccctgtcttaaaaaaaaaaaaaaaaaaaaaaaaaaggcagcacagaagactgagagggtggggctggagtgtgtttcaattttaaattaggccttgagggccattgagggaccttggctctcattgtgagtgagctgggagtcatggagggttctgagcaggggaggagcctggcctgacttaggcccttgcagaatcactccaccaggaggccagagtgttaggacccagggtggaggctgcgagctcggggaggaggtgaccgcacacaggatggcggctgggcttggcggggcagtggagtggggagacagagtctggatgtatcctgaaggtggaacagacaggattagctggtggatgggacatgtcggtggcagacagagaggagtcggggatgaatgactccctgagcctctggggagggtggagctggctgcccttaaggctaagaaggctgtgggcagagcaggtttctgcgggagatgaggagtgggttgcggatgcattcaccctgagttgcctggcagtgtggacgtggagtttgggtttaccctcgtgttgacaggtacacgctcgcggtgcggttatcacgctgctgctggtgtcaccacgcgggcgctgcagggacggacctttcccatcgccaggctcttcggggactgctgcaatgccccgtgcagccgccagggagcgcccgagccgcacccaggacgcgcggggaccgggtcatcccgcgggctacctgtgcggggcaggacgcttagccgcacccttggcctccgactactcggagtctgttgcattcctccttccccccgcgcgccgtgtgacagccaaaactgtccccagacattgccaggcgccccctggaggggaaagtcgcccccacggcagtcagagccatggcctgcgcagccacattcatttactgagcgcctactgtgtgcctgcgtctgggctccgcaggggctcacgggggtttctccttttcatccaggtttctgttcagatgtcaccacctcagaaagaccctgtcctagacacgctccattcaatgacccgaaaggatcttgttgaaatgttaacttattacatttttgggtttttgttgttgttgtttttggttttgctttgagacaaggtcttgctctgtcacccaagctggagtgcagtggcacaatctaggctcactgcagcctcaacctcctgggttcaagtgatccttccacctcagcctccaagtagctgggaccacaggtgtgcaccaccacacccggctatttttttttttttttttttttttagtagagacagggtctcactatgttgcccaggctagtctcaaacttctgggttcaagtgatcctcctgcctctgcctcccaaagtgctgggattatgccactctgcctagccttctttattgtctgtctcccctacccagcagacaaacccctgccctcttagagtgcaacttccagtgagccagatggtcacctctttgaagtggtggcatttgagttgtgccttgaaggatagaagctgccgatcatggcagaatttgaagaaaggtctttcctggcagagggaaaagtcagggcgaaggcctaggggctgctcaagtccctgccttaaggcatttagagcgtcctgcccagtgggtgatgggtccccaggccacacacagctgctggccgagcgccccaagtcatcaggaagccatgtggtgtggacaagggccaggcagcctggacacacaaaggcccattgacagctgcatgggaaaagtccagggcacccaagccggaagcccaaggctggtccctcttgtcaactcccaaggagctttgggtggggacaatagaaaagccagaccttctcaggagactcaagtttccctggggtggggcaaaaatgcaggtggcctggtcactgggacatgcagggcagctgtgtgaggcttttgcagtcccccagccctggttctaagtctagccctgccccctgctagcagagtgaccttggtcatgtcatgctccctctcagaccctaagttccctcatctctaacacagggtgaaagctgggtgcagtggctcacacctgtaatcccagcattttgggaggccaaagtgggtagatcgcttgagtccaggagtttgagaccagctgagcaacatggtgaaacctcgtctctacaaaaaatacaaaaattagctgggcatggtggcacacgcctgtagtcccagctactcgggaggctgaggtgggacaatcacttgagctagcaaggttgaggctgcagtgagcgaagatcacgcaactgcactccagcctgggcaacagagcaacactcagtctaaataaataaataaataaatacaatggggtgaaaaatagaagcaaccttccagcaatggtgtgagactgcctgggtagagtagtgggaaccaggcctgattcagcaggtgtttaagagcaggtggtcagttccagcagtcagctatagtggctggctggagtggccatctgtggcggtcagtagtggtggtcggtcatagtagtcaactttcatggtcggctatcacgacactaagcatgaggaccgtcaggtgagcatggctggggtgtttggtcagacagacctgggttccacaggtctcctgctttccagtgtggggcagatatgatctcctttttccaagcctctgttcctccatctgtaagatggggataatgagagccctacacagggcaatgactgtgaagcgcccagcactgggattatagaatgttccagggctttggagggcagcctcagaagagcaggccaaggaaagcgcaggcctcccgactgaaggaggtctgcagagccagcaggtaaagagtggctataaacgaacaggagctgggcctccctccgcgggcagtggggacgcatgagggcatgttcccagcctgatagcaggaagcatttctggaaaagcccagctgaatagtgaagatagcagagcaggaatgtgaagaacgcagacctgggatcagcttgctgggctcaagtcccctgtactagctgtgtgtccttgggcaagttacttgacctctctgtgccttggtttcctcatctgtgaaacagggataagatcaacctaactaggctatggggttgatgtgaggtcctgatgagagaatatttctacaaagaatgacagataggctgagggccttaaacgatgacgcaggccaggcatggtggtgtgtgcctatagtcccagctactaaggaggctgaggtaggaggatcgcttgagcctgtgaggttgaggctacagtgagccgagattgcaccactgcactccagcctgggtgacagagccagaccctgtctcaaaataaataaatgatgttggactgagaaagcatcaacactcacccaggctctggggggaaggtggatgtgagcaaggccaggaagagccaggaggaataggaggcaacccctgtatgtttgtgtgagcgcagccaggtgccagggtcgggggcggcaggagcagaaaccctgagaatgtaaaacaattcagcagcggccgggcacggtggctcacgcctgtaatcccagcactttgggaggccgagacgggcagatcacgagatcagaagatcgagaccatcctggctaacacggtgaaaccccgtgtctactaaaaatacaataaaaattagccaggcgtggtggcgggcgcctgtagtcccagctactcgggaggctgaggcaggagaatggtgtgaacctgggaggcagagcttgcagtgagccgagattgcgccactgtactccagcctgggtgactgagcgagattccatctcaaaacaaacaaacaaacaaacaaacaaacaaacaaaaaattcggcagcagtggcaatggcctcagggactctgagagctactaacacagccacctggacccacataggaaaagcaagcattctgagatcggaagtatgaactttggcctgggacaatagggagccactgaaggtttggtagtcaagggtcagcccctcttaccctgagagttgatataactaggatactccacagcttcatccccagcacctacctcggggcctgcaacatagtaggtgctcagggaaatgattttaaatgaagaaatgcattaatgggtgaatgagaaactggctactaaaagctggccttattttgcccttcacccacatagcactgggtacctccagggacttagatacagagggaccagcaaaggtaaatgtccggagtgggaacaagctcagggagacagaggagcagtgaggaggccagagaggctggagtagagaaaacaaagggagaacggggaggggaggccccgcggaggtgagccggctggacctctcaaggccttgcgagtagggaatagcgctttcttccaagtgcagtgggagcctccagagggtttggtggttgtgtgtgtgtgtgtgtgtgtgggggggggggggtttgtttgattggtttgttgttgttgttgttattgttgttgttgtcgtcattgtttttcagacgaggtgttgctctgtcacccaggctggagagcagtggtgcaatctcagctcactgcagcctcgacctcacaggctcaagcgatcctcctacctcagcctccagagtagctgggactacaggcacgcaccaccatgcctggctattttttttattttttgtggagacagggtctcgccatgttgccagggctggtctcaaactcctggactcaagcgatcctcccgccttggcctcccaaagtgcttggattacaggcatgagacaccatgcccagacagttgcattttaaatcctcctatcaaagagcataggcattattatccccatttcacggatgaggaaactgatgctcagagattgaatgatttacctaaggtcacacagctacgtagagacagtgccaggattcagcctcagcccattgggctgtgggatctgcagggctggaggggatagaacaatgccagctggagccagcactgctccccatctgctaagctctgccctacgacctctaggtgacactgggtgttggcaggcatgaaggacctacaccgtgggactgtggggaacacgaccaggccctgatcagtaggtctgctgagtcaccaggcctggcccagagctaacctccggcagccaggagccgccccagggtccgtccttggtgccctgcccagcagctgccaagcacagccactgccacatgagctggatgtcctgcagaagccagagtgacaaactacccccaaatctgccctcctccctgtgctgtgtggcctctggcaagtcccctgccctccctggcctgcggtgcacctgctgtctcgtgcaagccccaggccgcagtgcccctccctttgtgctgggtagaatcctggccaattgctgataccgagtttagaccggagggcagaaaggcgggacaggtaagtgcagacagtggggaaggctgtgggccccacaggactagactcttgtgggtgtggcggaggacaaggctgcccatcagagccccaggggcccaggctccacccaggtaacaggacacaagaagagagagcctcctaagcagaactcggtttctataagcaagacagatagatagggcaagccagctagcatttattgagcacttaatatgtgctaggcattctacagctattctcttacttaatcttctcaatagcgggtgatgatcatgatgcatggtgattcctgttttgcagatgaggaaactaagacctaaagaggtaaagtccttgctcaaggtccccaagccaggaagtggcagagccagggtgaaatccaagtccttgtcattccagagcctctgcctggacctggaagcccctcagactctaaagctctaatccccccccaacccccccagcaaagtgcagcattcaggactgagcctcaagggaccagccaggtctgattgtgaacctcagagcaaggcaggattgtcagtgcagtaacgtgagactggtggggcctgatggcctccttggggacagcctgggacaatcgcaaacagaagctggctctgtgctggagcttgccctgtcctggggacctctcccacccaggacgagctcacctcaacatgtaagtcacctgggacccgaggagcccattctagggatgtaaaacctgaggcccagaatgtccctctaacgtgcccaaggtcacacagagagtgagcacacaattggtactactggaacccagttgcctgtcttgtgcagcctcagtttcttttcctcccgggatctcctgtgttaaaaaaaaaaacatacaacgtggccgggcgcagtggctcatgcctgtaaccccagcacttagggaggccgaggtgggcagatcacctgaggtcaggagttcaagaccagcctggccaacacagcgaaaccctgtctctactaaaaatacaaaaattacctgggtgtggtggtgcctgcctatagtcccagctacttgggaggctgaggcaggagaatcacttgaacctgggaggcagaggttgcagtgagcccagatttcgtcattgcgctccagcctgggcaagagagtgagactccatctcaaacaaaacaaaacaaaaacaagaacaaaaaaacgcacagtgtactctcttgaccctcatcatcttccaacaagcaccctggtcctccgtcccacctaaggctgaacttctggtggaagctgtgcatactcccccacccactttcacaccccgccaccctcctcaccctgcaccctcctcacctcaccccctctcctcaccccaccctctccacaccccaccctctccacaccatcaccctctccacaccatcaccctctccacaccccaccctctccacaccatcaccctctccacaccatcaccctctccacaccccgccctctccacaccatcaccctctccacaccccaccctctccacaccatcaccctctccacaccccaccctctccacaccatcaccctctccacaccccaccctctccacaccccaccctctccacaccatcaccctctccacaccccaccctctccacaccatcaccctctccacaccccaccctctccacaccaccaccctctctacacggccaccctctcctcaccgccaccctctcctcggtgcccttgagcaggccttcatcccctgtgtcaccaaatggctcttggtgttgtgatccttgctgccaagtcccagtgtgggatcccgtgctcagagccacttctcagcaacgtttgacactattgacctccctctccttctcgaaacatccttcttgaaacagcctctattcctgacactagatgctccatgggccctgcctctcctcctcctccctggcagctccaactcagtggctttaaacaaacatgtgttctgatacatctcagactcccaacagcatccttgatctctctccagggctctggacttgaatgtcgagttacctacttgaaatatcctaaaaacacagcctggttccccacaaagacttatttcattcctccttccttatctccgcactctccagtctttgttcctcagtgacaccaccctgtagctcaagcatcaaagtgacgtatcattctcaagtcctctgtttccctcccaccacctccaaaatttgtcctgagttttccatttctctgtaaccccatggccaccaccctggtccaggctgctaccgtcctcacccttgacctccttgctgtttctttttggggtttttttttttttttttttttttttgctgctacatttgcttcccatgctgccgggggaactttcagaaacataaatcaaaacatgtcacttgcctgctggaaaccttccagtggcctctggctgcctttccaaagactcccaagtcctcacattggcctacaaggccccatcttcttctccagccttccctcctcccttcctattcagccacattggcttcctttcatgttctccagcaagccaagttctttcctgcctaggggcctttgcacttgctgtttcttctgtctgtaactctcttccttctgctcttcctataactgcctctttctcttcttttaaagcccagctcaaccatcacctttccagagatcacttccctgatcatctaattgaaggacctcacccttcaccctggtcactctcaaccctatcatcctgtttattcccttcataactcagcaatgtcgggagctcacttacttgttgacttgtttattgtctatccacctctcttccccagaatgttggtcccatgaaggcagggatttaatatctttcttattcagtgcattagatggaaaccaggtacacacagcacagtgcctggcacatagaaaatgctcaataaatattggatggatggatggatggatgagatggatgaatgaatggatgggatggatgggatggatggatgatagatggatgggatgaatggatggatgtgataaatggatggttgagatgaaccgatggatgaatggatgggtggatgggtaatgaatagctggaatgggtagttggatagatggatgatggatgggtggatgagatggatggatagatggatgatgagggatggatggatgagatggatggatagatgggatggatggatgggatgaatggatggatgaaatggagggatgaatgaatgagatggataggagggatgaatgaatgggatggataggatggatgaatagatggatgaataggtggatggatgaatgggtgggtgggggatggatggatagggtgaatggatggatggatgaatggatagttggatcgatggatggatggatggatgaatgagatggatgggatggatggatgaatgagtgggatggatgagatggatggatggatgaatggatgtgtgggtgggggatggatggttgggatggatgaatggatgagatgaatggatggatgagtggatgacatggatggatggatagatggatgggatggatggatggatggatgagtggatgggatggatgggtggatgaatggatggatggatggatggatgggatggatggatggaaggacggatgggtgggtaatggatagatgggatgggtggatggataaatggatggatggaatggatggatggatggatggatgagtggataggatagatggctggatggatggatggatgagtggataggatagatggctggatggatggatggatgggatggatggatggatggatggacggatgagtgggtaatggatagataggatggatggatggatgagaggatgggatggatgggatagatggatggatgggggatggatggatggatatgcaaccagataaacaaacctaaagtacacctttaatcatgccactctccttctccagaacctaacttggctgcccactgcctatggaatagacagcaaactctcctctgggacattcaaagcgttctgaactgattccaaagtgggggtgcagtgagtgataagtgagaagataagtcattcatactgaagcattaggaagtggatcagttaaccatctctctccttgatctgggcatgagccatttgagggcagggtcatcttcatctctctgtctagacattgagcccttggtcagcaacatcagagatgtctgatgaataaatacatgactgagtgagcgagtgagcaagtgaaagcagccccactctgccccaaaaagccagcaagcgaaaagcaggaagcttcagacccagagggctgaacagttcaaatttagaataggagagcagtttcactgtttcaggtcactgctcctggccaaggtttcaaaagtatgtaaagctggggctctgcagcaacaggaaaattgaaacttaccagaaactagactggcagtgtctctcgggagggactgatttgaatgccaatgacctgatcctccaattataagagcagcacagtgtcagactaaaaagcacactcccacgtaattgcaaccaaagccacaaagactcccacaactaagagtggcacttcttcagtgtcccgtcctgctgacacacttttggtttttgcagaccttgggcccttccattgtgactcttggtttgcaggtggaagaggagcagagctgtgaagaggagagcttggggtcacctcagctctgccagaggttctgtgacctgccagaggctctgggaccttccctgagtcatcatctgtggagaaaggacttgccactgagtggtgtgttctacttgtaccgctcttctgatcgatcagcgtctttgattgggttccctgggaaacagactcagagagctgggcacgcaggtggtttactggggagtgctctcacgcacagcacctgtgaagggggtagagtggtgtggggggcagtgatgtggggctggaatgcaggcacaccagaggcctcaccagagctcagaggctggaacagcccttctgagttgcctacatcaggaccatgaaatggggtccttagacccccatgtcaacccgacgttggaggtggcctgcccctatggaggaggcagtcttaggcaaggcgattctccttggctgaaggcgaatcctggagcctctgtcctgaaggagaatccaggtggcagactacaatctccactgaagtccactcctcttcacttccaccgcctggagccaacccatcacctctcatctggatgcagccttaagatcctccccagagctcagcattcatgcttggcccttcaccaacagagtccaatctgcaccaggaacccaaagccacaggaggtctcccagcacagaaatcagatcacttcacttcactgcttgaaaccctcaaatggcctcccagaacaaaacacactcagaataaaatcctgagtgatccctgcctctgcctatgacctctcccttcactgtgcttcagccctttctctctctctctcttttataacaatccatcatgacgttcaatgttctctttttcttgagacagcagctgtgttccaccgcagggcctttgctcttgttgttcccgctgcctgacgttctcttccctcagatcttcccatggctgactctacgtccttcaagtttcatctgacacgtcacctcctcagagggatattccctggttatccgatctaaagtggttccacattcctcgcacgttaccttccttttaaaccacttctcactgtctgaaactatcttatgactttactagttgacttcctgtctccttccatcagaataaactccgtgggggtaggaatcacatctgccttgttcaactctgttacctgcagcctctaaaccagaaaccaatgcgttgtaggtgttatctatttgttgaatggcttaataatgatttcatgattctgtctccttacttattgctaatcttgctctttttactgtttgccttaatcaatcagatttgtcaggatttatctgtcttcaggtgctttctttttaaagaacacctttttcactttatttatcacttctactttgttttttctatttcattaattgcatagtttacctttaatttcttattcctatccttttggcttcttatattttctattttcttaagttaaatacttaatccactttgttttcaatttttaaaaataatagacgtctttaaggctatacattttcctctgtaggcagcattagctatgtctcacacactttggtatgaacagtgtctgctttttaagactctagataagtttccatgttggttctgattttcctctgattcaggggccatttagaaataatagctatttttcaagaagttaaaattttgaggttgcttttgataatttattctgaattttattggattatgaaatgagaatgtggcttggaaacatctctactttgcaacttcactttgccatttacaaactctcactagaccagagtttccttgctgagcatgtttcctcatctgtaaagcgagcacaataaacagtggctacagatttatgccaggtgtggtggctcatgcctgtaatcccagcactttgggaggccaaggcaggtggatcacttgagatcaggatttcgagaccagcttggccaacgtggtgaaacctcatctctagtaaaaatgcaaaaattagccaggcatggtggtgcacacctgtaatcccagctactcaggaggctgaagcaggagactcacttgaacctgggaggcagaggttgcagtgaggtgagatagcaccattgtactccagcctgggcaacagagcgagactccgtctcaaaaaggaaaaaaaaaaaagagtttctatggccacctgggataggaggcttttcttgaagccactttaccctaataaacccattgtctttacttatgttgtatttatatctgcagcggccttgatgctgtcactgaccactgggacaccccaggcctgacaggcagctcctgacaccaactcaaatgctagttccgccgggtgcagtggctcacgcctgtaatcccagcactttgggaggccaaggcaggcagatcacctgcggtcaggagttcaaaaccccatctctactaaaagtacaaaaatcagccaggtgtggtggtgtgcacctttaatcccagctattcggaaggctgaggcaggagaatcacttgaatctgggaggcagaggtggcagtgagccaagattgcaccactgcactccagcctggatgacagagcaagacttcatctcaaaaaaaaaaaaaattattttgctgagagaaatctggactatacattccagctgtgaccaacttatgacactgcagctatatttttattagtcagtggatctaaaaccaaaaagtgtgaaaaaagaaaaatttctcaatgataggcaaacaaatcttaatatgtggtttattactttgtatttggttccactgattattctgtcaacaggaatgttagtggccttgccaccagcaaggttggcaatcttggctcccagttacttctcttgtaggtcggtcttaagaacaaggctttggccaggcgcagtggctcacgcctgtaatcccagcacttcgagaggtcgaggtgggtgaatcatgtggtcagaagttcgagaccagcctagccaacatggtgaaaccctgtctctactaaaaaaaaaatacaaaaattagccaggcatggtggtgcgcgcttgtaatcccagctactcaggaggctgaggcaggagaatcgcttgaacctggaaggtggaggttgcagtgagccgagatcgcgccattgcactccagtccgggtgacagagcgagactctgtctcaaaaaaaaaaaaaaaaaaaaaaaaagaaaaagaaaagaaagaaagaaaaaggcgttaaggctttaggattggatgtggtggctcatgcctgtaatctcagcactttgggagactgaggcaaggggctcacttgaggtcaggagttcaagaccagcctgggcaacatagggagacctcgtctctacaaataacttaaaaattagccaggtgtgatggcgcatgcctgtagtcccagctactcgggaggctgaagtaggaggatcacttgagaccaggaaattgagcctgcagtgagccgagatcgcgacactgtactccagcctgggcaacagagcaagagtttgtctcattaaaaacaaaacaaaacaaacaaacaaaaaaaaacagacaacaaaaatagcaagagtactttagatttatagacggtgctttgcagtgaagctgccatgatgaaagcttccattgaccgaccacctgtcgtgtgtgaagcattgttcttggtaactcacatatgttgctgcatttcctcttcacaataacttcatgtggaaagttttaccacctcccttctccaaatgagaaaacagtataagagaaatgtgactttaccaagagcacccagcttctgagtgggttcagcctgggggtgtctggctcttcctacatctggaatcttcagattgagaaggttcattgtcatttactcagcaaatatttgagcatctgccccttgccttctgtcctgcagtatgccgaattctggactaggtgctggagatggaacagggagcaaaacagcgtcctttgtcccctgtcccagttgggaagaaagacaaagaaaagacaaacaaaacaaaacaagacgaaaacagcacttcacagtatatatgatgttagagagggacggggcagctaagattctcaacagttcatttcagtactaaactgttttacttctattctgtttcttttcttttttctttttttctttttttgagatggagtctcactctgttgctcaggatggagtgcagtgtcgcgatctcagctcactgcaacctccacctctcgggttcaagcgattctcctgcctcagcctcctgagtagctggggttagaggtgcccgccaccacacctagctaatttttgtgtttttagtaaagacgggatttcaccatgttggccaggctggtctcgacctcccaacctcaggtgatcctctgcctcagtctcccaaagtgctgggattacgtgcatgaccctctgcacccagactctattctatttctgtcatcaggcggattgacagacacaaaaatgtagtgtctctattgccctagatctctttagccatgtccgaggaccaaggaatgtaaaatttatttgtttttgagacagggtgtcactctgttgcctaggctagagtgcagtggtggatcctcccacctcagcctcccgaatagttggaagtacaaacgtaacaccatcatgcccagctaattttatatatatatatttgtagagacagggccttgccatgttgcccaagttggtcttgaactcctggcttcaagcgatcctcccacctcggaatctcaaagtgctgggattacaggcgtgagccaccgtgccgcccagcccagggttctgttgtaatgagcgcgtccttcttgtggtgtgtcctttcttcacttgcagtcttcactcacagccctgccatttcttgttcctgtgtaatctgtcactttgtggcacttccttttcctctgtgttgacagagcctggcttgtttagccactcttgtgtcctcagggggtttgatttccttccatgttattgctattatgtgttacatagcgatgaactagccaggacacattgttatttttcccctggtttgcctccctgttcgtaatcctccgtcaccgttcacatttctattgattttcagccaaactcgggggttggcaaattacggccacccacctgtttttgtaaataaagttttattggaatgcagccaagcctgtttgtttacatattgtctggggctgcttgagctatgagggcagaattgagaagttgaatagctgagtgacagagactgcatacagcccctgtgacggtggaaaaaacaactgtttttcctctgctctcacactacagcaatcaacactaaagactttttttttgagacatagtctcactctatcacccaggctggagtgcagtggcacaatctcagctcactgcaacctccgcctccgggttcaagtgattctcccacctcagccgccagagtagctgggattacaggcacccaccaccacgcctggctaatttttgtattttcagtcaatatgggttttcaccatgttggccaggctggtctcgaactcctgatctcaggtgatctgcccacctcagcctcccaaagtgctgggattataggtgtgagccagtgcacctggccacagaacatctccatgaccaaatgtgtgtctgtttttccccaagcaccaagcagtggacaccagcggggcatcccccaattccactccgatgctgtctacctgaagatagcctcgggtcacacaggttgagggctcagtccccaagactgtcccctccttcccaccagtcacaagtccaggcttccagaacttctgaccgatcagctccaaacccgctctttgggtttaatttatttgctaaagcagctcacagaactcaggcaaacttacttttacgtctactggtttatgacaaaggttcttttaaaggacgcagttaaacagccagatgagacacacacagtgaggtctggaagggtcctgagcctgtccccatgccaccctcccagcacgtggatgagttcttgttcaccttcttacaaacctccgtgtgttcagctatctggaagctctctgagccctgtcctcttggcttttttttttttttttttttttgagacagggtcttgctctgtcacccaggctggagtgcagtggtgcgatctcggctcactgcaacctctgcctcaagggttcaagcgattctcctgcctcagcctcctgagtgagctgagattacaggcatgtgccaccacgtacagctaatgtttgtatttttagtagagaaggggtttccccatgttggtcaggctggtctcgaactcctgacctcaaatgatccacctgcttcagcctcccaaagtgctgtctctccatctgactgcaaggaaatgaagttgcagggaagtgaagtgacttccccaggccatggagttgttggctgtagaagtgcaaccagcagatcatctctcctgggccctgctcttcctagaattcacagtggaagatgtataccctactcccacctattccttacctccgagcctccctacacagcagagacctctctcctacatgactgccacccaccattgtcctagaaataagtcaaacagtggcatttgtcagtcccacatctagtcgtagcagggtgctgtgtggggcgggcgtggtggcagagaaaaggtgtgtcttggagcagtgagaaaagtactcagggctgtgcttcctcaaggagtctcatggcatgtagcctgcctggaaagttttctgccagcatctagcaggttgcatttcacaagcggcataaatcctccttaaccgtttgcccttacagctagtttgcatgtgatggtaaatctgaattgttactcagtgactgtatttattaagaacagcccacctgcaaggtactgtggcatcgagggtaccaggttaggaggaaactagcatttttttttttttagacagagtctcgctctcgttgcccaggctggagtgcaatggcactatctcagctcactgcaacctccacctcccgggttcaagtgattctcctgcctcagcctcccaagtagctgggattgcaggcgcctgccgccatgcctggctatttttttgtgtatttttagtagagacggggtttctccatgttggccaggctggtctcaaactcctgacctcaggtgatccgcccaaagtgctgggattacaggcgtgagccacagcgcctgacctcagcaaaagaatttggtaagtctagaggtaaagcttaatactgtaaagatgctaaagatgctgtcttcccagatcattaatttagtgcaatgtcagtcatgatcctagattttaaaaagcaattttttaaaatatagagacagggtctctttgttgcccaggctggtctcaaactcctggcttcaagtgatcctcctgccttggcctccaaagtactgggattacaggcatgagccaccatgcctggcccttaaatagatttttaaatataacttgacaaaataaatctcaccggattgagaaaatacataaacatagccaagaaaaacaatttttttgagtcagagtctcattctgtgtcacccaggctggagtgcaatggtgcaatcatggctcactgtagcctcactctcctgggctcaagtgatcctccagcctcagcctcgtcggtagctgggactacaggcacacaccactgcacctggctaattttttcttaaatttttgtagagacagggtttcactatgttgcccaggctggtcttgaactcctggcctcaagtgaccctcctgcctatgcctggctgaaaattttgatgagaatggggttgtgtaagtatgttcaccctgacaaaagagctgtttgctttggatttatggacttttctgtatgtatattacacttctataaatgtttacaaaatttggggtaggatatagaaagtagagataaacttgtcttataaaaacatactacagggctatcataattaaaactgtaaggcataataagacaaatagctcaatgaaatggaagaatcttgctacagaatttaatgtgtaagacatggggaaattattgattgttcaataaatactgttgagacaattagcaatccatttggaaaaaataaattatagaccgcccctcctgaccatatcatacacaaaatcccctttaattccaggggttaaagatataaatagcatgatcattcactgatggtagaaggattaattcatactgcctttttgtaggacaacttggtaggctccttcaacatttaaaatgtgcaggtggggcgtgatggctgacgcctgtaatcccaacactttgggaggacaaggcgggtggatcacttgatcccaggaatttgagaccagtgtgggtaacatagtaagaccctgtctctacaaaaaatacactaattagccaggtgtggtgtgtgtgcctgtggtctcagctactcaggaagctgagttgggaagatagcttgagcccgggaggttgaggctgcagtgacccatgatcgcaccactgcactccagcctggggtgacggagtgagaccttatatcataaacaaataaatatatgtatgtatttgtgtgtgcatgtgtgcatatatatgtgtgtgtgtgtgtgtgtgggtgtgggtgtgtatcccttgctccaacaatttcatttcttgactctctcaagttggcctacacatatatgtgcacatggattgatgtgcatctgtgttcactgtggtgcatataatgtgatagtggaaaactggaaactacctccatgtccattaggaggggaatggctaaattacatacatccacacaagagattaccatgtgtcacaattcaaataataagataggttcagtcattcatgcaacaaatatttattgagcaactactatgtgctaagaccagttcttagctctggggatagagcagaaaacaaaacagtctctgccttcatggggattatattttagtggggttgacagccaatgaacaaagaacaataaaaatatagtacgattcagagtgagaatattgtgaatcaataaaacagggtaaggggggacagggacagggaggtggcatttcagactgggtgctcatcaaatcttctccaaggaggtaacatctgggctttatttgagggagctcttcattcacggaaaagaggtctccagaaacattaagaaaaaacaaaacaaaacaaaagtaattacaggacaacttatggtttttaaactatgcctttgttttcctaagcatgcatataggtatacaggtatagatctggacatcagccaatggctggacatggtggctcacacctggaatcccagcactttgggaggccaaggcaaaaggacggctggagcccaggagttcgagaccaatctggacaacatggtgaaaccccatctctacaagaaatacaaaaattataaaaattagctgagcgtggtggtgtgggcttgtagtcccagctacttaggaggctgaggcgggaggatcacttgagcccaggaggttgaggctgtggtgagctacaatcgtgccactgtactccagcctgggtgacagagactccgtctcaaaaaaactaaaaaatgtagacatcagtcaaactgctaatattaaaggagtggtttaacacttattttccagcaagcacatattcacgttacttttagaatagacttttcaactctgtgaacaaaagctatttagagcacatatgcaaaagagttgggtcagcagaagcagcctaggggttaagagcgtcttccctggggcaaaaatgtccccagccggctcagctgctagctttgtgacctcaggcaagctgtggcttcagtttgtctagagtagctgttccatttgggtttgtacctagagggaggaggccaggggtgctgctgaacacccgacaatgagcaggacagctcccccatttgtcaagagcaatgtggagaagccgtgctccagaacaaggggcagtgcccgcctctcaagggttgaggactcacggtgtgcaatgcacttagcataggccctggcacatagcaagtactcaataaataggaactatttttattactggacttccctgaaaactaaaaaaaaaaaatgttgagagtatggaggacgtggtagtgccaggaatcagttctgctgaatcccaattccagcagctggctggaagggatctctgacctccacagcaacaacagtcttcacggggtgtgtgtctgccaatgggatggcctatacagagctcctcgttccttctgtttggtttttctggtttgaatctcatctcctgccagtagttcagggacattcccaccagatcacctggtctcttgtacgtattcagctgtgctctctcagacattccctgtggttcagaagaaacacactcaagcttctcttgtgggaaaaccaaaacccaaccccacctcacctcccacccccagcttcccgcgcttcctgtggccctgacctcctctttccaccccttcccaggaaatccaagagacacccactctgctgctatctcctccttccaccccatcaggtcagcaaaacggctcctgccacatttccaacacctggccactgccaactcactgcttctccctcttcctcttgtatcgcttctctgctgccttcagcacggctgaccactctccctcttggcctgcttgtcctcccacccctcctcctgctcactcatcctccttttctcaaccaggttctcagaggctgggccaaggctgctgccttctcttactccatgcttcctgttctcaatcccccagcaatctcacccgctgctgggtccttactaacctcctccacccaaagactccccagtctgcctgtagcccccaccctgctgtctctgccaggttgtctcaaaactccctgaactcagcagtcacaactgatctcgtatctatcccgccaatctggtctgactctagtgcccccatctcagggaatggccctgttacctgtgcaagtgggaagccagcagcttaggtggagtcctccatccccatcacccctggcaggtcctgggagcacgacctcagtatctcccagtctcccctcctccgtcgtccctgcacccatctcactcgcccctgcttctcttctgcttctgtaccatcgctcgttctccctgcaaccagagccatctctcaaagttgctatggaatccgaatcgcatcacgcagccctgcctgctgaaaactcttgaatccactgctctaaggatgaaatgcaaactcctccccctgtgcgcccccctgccccctctactccagccacgctggcttcctccctgccctgcagctgtgtgccacacgctccttgtctccccctagctcacttgcttccaccttccctacattcccaactggaatgcccaccctaccatgcactcgtcacctgcagcttccccttttggaccaggtattgaggatacaattttaatcataccccccagtggaccgtaagtttaatgagtccactgatcctgtcttattttctctattattatgtccccggcatctgacactattaatactgtgagtggcaaacattcaacacatagaagccatgatgacaatctctgagcagaatctggcatataaaccctacactgatcccagagaaccttctggaatcaaactccatcaaccctcaccacccccttcacccccaagtcccctcactcaagtgtcttatgcaactttcttggtaccacctgggtgattcttgaaagaaaacccaagcgtgggcatgcctgggcagcacagtggaggactgcttctgttacactgcgtagctttttactcagcccgttcacctgcagcacgggtcaggcagtatttaccccagcaagacccagagctcagctgagctgccttaagttgaactcctgtaggaaaggaaaggaaaaaggaaagacccccaaggacccaaactgtcctacacaaagagaaatgaccaccaaggtttggttcttgaatatgtattttttactgaaaaaatcattcataaattaacatacaaaaatgtacaaacacatgagtaaataatgtaatgacaaaggactatttttgtgaaaagtgttttttaaaacatctttagatttcagtgcaaaaatgtacccctggcacctcttaaaacgtaagagcaagctcaaaaacacgtagtgatggaaataagctagctacgctcaatgccatcgtcaatggtgagtggatacaatcaatccatgtggctcctgctcagctattaatgtctgtggtagaggatctctgacaagaggacctattatgtcaaaatgagtattcttgcaaatacccccccaccccccaaaacagcatgaacaaacggggacacctttccctgcacacagcaatcaaagacaagattaaggggccacccatcagtagccttgaagattttcagctaccaatatatgcacaaggtcacatttggttcctgtttttttttttaacatgacaatttcacactattaacagcacacgggcctggctgtacgtttttaactatgacatttcccatatgatattcgaggcctggtggacacatgactgacagtgcacatccagagattctacactcatcagacacagacatgaccgcaaaggtatcaaagtgaccccactttaagcagtgaaaaaagacctttccttttgttctcaaatcagcattttctaaagtcaggtgttagccttttgccaacagtgtgtacttgatggtaattatggcaacatagagcttcaaacaagatcgcctgacaacactgccgcatacacatacggcacccaggactcagaatcagtctgtcctggcaaatccttccaaatgacatcatagtgttgtcacattgaaagcaactcacagccttcagtgaggaaaggggagaggagaatgagaaggggagaaaagccaaggcagggacaaaggcccggtgggggatgggggttgcagggtggaggggggtctttattgctatatgcaccataaaacaaaggaaaaccaaatgaacttctgtgtgtaatgttcacttgtgaaggtattttaaagcatgaaatgcttaagtcttaaaaaacatatgctatagcttaccggcattttcaagggcaggaacctgctctctcatatgagccgataagagctttgcaatgcaatttattttctaaataccactctattcttcaaaagaacaaaaacacaaacaaacaaacaaacaaaacaaggcctggccaatcactcccacagtttgtggggatcatatgtccacagaaccatcacatgcaacgaaaaaagccctaacccacacacatacacacacacacccctacacacacccatgtaaactatgaaaatcaaggaagttgaaggcaaacaaggcaattaaaaaaaaatacgaagtactcttcagaaagtactcctcatcacaatatataaatatgttttatggaaaacaagggcgggggaggaaaactggcattttccagaattctgcagaagccgacagagactacaatttgagggctttggtttggggaaaaacaaagaggcacaaattcaaatacaatttagaacatgacttcaaggctgggcgcaatggctcacacccgcccataatcccagcactttgggaagtcaaggtgggcggattgcttgagtccaggagttcgagaccagcctgggcaacatggaagaaacccctgtctctactaaaaatacaaaaaattagccaggtgtggtggtgtgcacctgtagtcccagctactcgggaggctgaggtgggaaaatggcttgagcctaggagatggaggctgcagtgagctgtgatcgtgccaccacactccagcttaggcgacagagccagaccgtcttaaaaaacaaaacaaaaaataatatgacttcaaaatgcaggtgggggtgtgagcagtgcacctgggctcttgctgtctggagctttgttagtctaatttcaaagcttcaatccggtcttacctggatcccagctgccccacagcacacaagtgtcaccagctccctggctcctggctccctatttgagtgctccttggttctatgtatcagttactaatgttgacaaagaatctttccagaaaccaaaaagggacacagaggaatcactgaagccagctggtaatgtaggcacattgttcagaaactgtggccaagttccacaagagaaaaagtaagagggggagggattcccatacacacccccgccccccgccccccgccccgccatgctgatgaaaagacagaacacgaagcctggagagccagagatgtgtgtgcagcgagccccgaagggcctgctttaggcaggaagcagcctgctctaacagcagcctcccgcttagcggagagtgggatgagcacatgcgcggccgacagggaagagtgaatccagagcagaagtcaagggcaagactcgtgggggggggaagaaagggacagaagccagctcccagcaataaaggtcgggttattttgttcttttgtgacatgccctatatccactccctcgccaaagtgacagcaattcgggagatgacattcttcaactgcattttaactgagttcctgcacttgccaaccaagtaagtggcctaatacataaatcctcaatttgaattggagccagctagaaaattaaattttaaaaaggcattttacatggcttatttacaattatacttcttcaagaagtgattgttatatatttatgtctatttatctttcccaaacaccctcccctccaccctcaatccccacccaaagaaggtaattttttaaaaaaatgaaaccaaagagaacaccagagatctagaagaatggtgtggagtttcatttgctcttcctaaaacgcagctgccctgtggtgggtttgcctctgctctgaaggccaagaggctccaaggtcatgtgtagggacaggctccacggcaggaccacggcaggaccacggcagatcacagttcatcatgggttctggagactgcggctaagacaggatgtggggtaggagatggggagagagcagcgggacagacgtctgtcttgtgaaaacagaaagccagtgctgacgaaggaagtccccaagctcactccctcagttccagcggctgatccagtgaaggcgtttgtgcgtgtgctgtcacattttccccctgaactctgtgatccttcatgagacacagtatttctgttctcttgctgtgtagaccctcccccctccaaaaaaaaatctcatcggactgctttcttggtggcggtgggtaaagcaaacgtacattctctcctctcagtactcgttcacctgagccagctcgggtgtcaggttgacagttatgtttttatacaaggcgtcgtatgtgatgtttgcaaagtagttcaggttgttgaggccatccagcccttgccgttcttttgacttcctcagcagagcatacctgtttagggagggaacagagaagaggtggctctgagtgaggatccatgcctctgcagccagaggatggagcagggcgtcccacagcagaggacgcaacccatggcagcacttctgcagcacaaggtgggcgcacggccaattctgctatgccaggctgagtgctgtggtcagaaacacctcctgtgtttcatgccaggtgcttcacttaattatttcatttaatgctcacgccagcccctgctagcaaatgaggaagccaaggcttaataatgtgaggtaacttgcccaaggtcagagagtggggaagtgggaggtaaagcattaaaaatacaacagatgagaaagttcatactctgtattcagtgccattttactcccatgaaaacagaatttcagcaattagaattggttgtctagagcacagtcttccccacaatttagaaaagacacacacacacacacacacacacacacaaagaaagaaaaggtaacacagcaactgcagccacccagacagaagctcaggacaccattcggaacgggagcctgcggaaagggcgccactgctctgtcacctcagggaccttcatccaagctgtttcttcccaaattccccaaaggctactgtggagaccacaaggctgaagacataggacaagtgatttccttcgaagaatcttactattgaaaatgttcaccaacggtctgatccccacactgttctgcctcagagttagaatacatgcaacagctgtcaaacagctgtcagaacagggcctcggggtggggagtaggagaaggggctgtaatatgctctaagatatccggacatgaaagtataggggatacttctaagagacagagataaattccaccaaccttccaagaaactggacttctcctcgatggtgatgaggaatggacttgtactttcctgtgtcaccctctggccggctcacagaatagcctgcattctgtactctgtccaagaccaagagaacaggcttttagatacaacggtaatagcccaggagtgaccaaagcctacaagacatgttacaagcttaccctggaaatcacacacagcaaaagctctcacccgcttaactgactcattgtgtcatttcttaaaaactgagttaaaactcaattttaactgaattaaagtttttatgtgaacggaaaaaataggctgggctaggtggctcgtgcctgtaatcccagcactttgggaggccgaggtgggcagatcatttgaggtcaggagttcgagaccagcctggccaaaatggtgaaaccccatctctacttaaaaaaaaaaaaaaaaattagccaggcgtggtggtgcaggtctgtaatcccagctactcaggaggctgagacaggagaatcacttgaacccgggaggcaaaggttgcagtgagcaaaattgcaccagcttgggtaacagaaagaaaatctgtctcaaaaaagaaaagaaaagtacggaaagaaatggttacttccagggaataaaatagaatcaaaatggggattaatacttagacacttgtatcatctaattttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccagactggtcttgaactcctgggctcaagtgatcctcaagcctaggccttgtgaagaggtgggattacaggtgtgagccacagtgctcagcctatcatttgaatttttattagcaaaatagtccttgtaattaacaacaaacacatacttttcaaaagccaagctacaaaggaaacagataccaggtagtattttgcatttgttccttatgaggttactgtttacttactccataaaaatattactttattccactcacacacaggattgttcacccaagcttgtacagtacaagccttatgtgatggcgcagctaaatctatgtagacatatcactaatattccacccttcagtttggagtggttccaatgaaatgggcatttagtacagagaacactggtgaagtgaaaagttttgttagaacctttagcaggaggggcacttagttataatatgccttaaaaaccctatttgcatccattaaaggacagagcttaaaaaaaaaaagagccttaaaatgactacattcgcttataggaatttttcctaaataggaataacaggcaaaagaattatctactatatcacactctaaatagtggaaaatggaaaagattctaaatatacaccaggaaatagttacataaattacagtacatctatataaccgaattaaatggagccacttaagatcctgtttacagagtatttaatgttgatataaaaacagtaacacctattgagagcttatcacatatcagatatgccagagctctatacacattacatcatttaatcctcacaatcctgagatttgtgattttaaaaactgacacacagagattttaaattactgttcacttgccactttttaaacacaaaataaactcaatgaaatggtaacatgttacttattgttgtgggtaatttatttttatactcatttgtattttataatgaacgtattatttattagaagaaaaaattgctaaattataatttgttgattttcgcatgtcaaaggagaaaaatgaaaatagctgctttgttgggatatacagtttgttttttaagatattaagatatttttaaattaagattaaagatattttctaaaaacttggatgtgtgtggtgtgtgtgtgtgtgtgtgtgtattttttaagacaggtctcactctgtcacccaagctagagtgcagtggcacagctctctgtggcctcgaactcccgggctcaagtgatcctcccacctcggccttccaaagtgctgggattacaggtgtgagccatcacagctggtcaatttcatttttttccttaaccttttaaactgtagctactagaacatgttaaattacacacatggcttgcattatattcctatcggatagtattggtctgcagtctaaggtagcatttctagaagacaccgaaagaacggcagaggtacctgttccagaggtcgtcatcttctccaccccaaccccagaaagcattaggaaagccattgattttccgaaattgttccactgttaagccactcactccgccaaagaactcggtataaggaagcctaggaggagatgtgggacatcaatcatctgtgtgttacagggtaactgttttccctagaaggttctcatttgaggactaaaaacagtgctctctgtgctcctgacctgaaccatatgaatgtatcaaattagcaaaattaatttttgcaaactgatttttaatagctttagtgagatataattgacatacccatacacaattggcccatttagagtatatcattcaatggttttagtttattcactgaattgtgcaaccatgaccacaatctatattaacatgtttcatcactgtcccccgcaaagccttgcacccattagcaatcaccccctgctcctcctatcctccttagccccttataaccatttatctactttctgtcactatagatttgcttattctggacatttcagacacctggaatcatatgatacacaacctttgtgtctggcttctttaacgtaatgttttcgaagttcatccgtgttttggcacgtatcagtatttcattgctttctcctgccaaacagtgctccaattgtatggatacacacattttgtttatccatccatcagttgatgggcatctaggttgcagctaattagatttccttttcacatcgctcaccatcctttcagatttaacctctttaattaagaagaaatgatactcacagatacatatacttatccaatttggttgcaaaatgcctcggcatctgtccacatccataatagttgcgatcactttccggtatgtgatctacatcatgaaaaatcaaacagtcccaatccaagtctttcattgcctcttgaaagccaacgttgaaaagcatggctcgattaaagggttgggtaccaacctaaaagaaacagaactttatctttaaaagaatcttgaaggaaaatctttgctgtctttcctgtgcctaaagacgagtttattagaaccaactggaaaagatcactgggctagtgtaaccaggtccaacaccacaaatcaactcacagtgtggctcagaagtcactggacctctggcatgggcacagtggctcacgcctgtaatcccagcactttggaaaaccaaggtgggcggatcaggagttcgagaccagcctggccaacatggtgaaaccccatccctactgaaaatacaaaaacattagctaggcgtagtggcgcatgcctgtaatcccagctacttgggaggctgaggtaggagaatagcttgaacccgggaggcggaggctgcagtgagccaagatcgcaccattgtactccagtttgggcgacagagcaagactccatctccaaaaaaaagaaaaagaaaaagtcactggacctctggccccaatttctttaaaaatgtaagtgatagcaaacgcaagcttctctctcccaaggctactgaaggcagaaatgcaaccgtgtaccagcatttagaagagtaccccgctccacaaagggaagagacaacactaccatttctactccttaccacttgctcttcagcacatcaaccaatctctaactgttcataaaccaaatctagtacaaagagtggtttttagttttgtcttgttttatttttaagatctaactaagacaacagtcactgagcatgccagggactcaagcctatggacaaagaattcagtggctcatgaagaaaccagttcaaatcagttaacagcctaattagtgttacagctacattgactcccccttgccactatcaaaatacccaacttaggaccggcagatagaccgttagcatttcccagatgcccagccttgctgaacagtggtgctcagcttttttctcactccagtataaggcaagctccagggtgaccacttaacagcaactcagactgtgagactcaaaagtgtgcccatagagagaggtgagcatgcaaaagaccctcagactgacgatcagtgtattcagggaaatctgtcaaccttttgtttatctatggatatagcacctctagttcaaggatcacatacttcaaaatgcctacagaagccaagtcagtaatgtaaacatataaagtaggcccggcaagagaaaaccacagtaggacagtcatgttccatctaaaggcaaataaaatatatgcaggaccaaaaaaaaaaagatttacagactgaatttgccatgcggtcttcttcagtttgtgacctctatatctggttccctaccaatatttttaagattaaaacaaaaccaaaccctcaggcttagagaagtttgcaaatgtcccaggccacttggttgattaacagcagacatgacaagcactgaggtctcttgactccaaggccacatcctctgtgctgtaccttgctgcagctctttatcttaaggggaacttcctgggtctggagcctgcaggcaccaacaaaaccataatacaagaggcctttgttcatgagccaacaaagctctctcctggattcaagtgtgcccagtactgggcaacagacatctcaaaccaggagcacagaattgctctctgctcccccttcaaacctcaggcaactcgatcctaagatttcagttttattggctcttcacaccaacagtggattagcttgcagcaacctaaactgctgtctcagaagagaaaaaagaaaggaaaagaaaggactactcacttgttcaaccacataaaatgcaaactgcaagcgctggcgctggagcatgggaagcaggtgtctgaacaggactgggaggtgctcgtggcggttccggaaggggataaggatcgccacctggagtggattacagcaaaagaagcacagttaggactctcagctttcactccttagcaggacacccctgatgaattgctgaccaacccatgggagttctgggaggctggctatcttgtcctcagctttctctaaacaaagatctatgttggcaagttggcccttggacctagatgaatgtgattcttacatataccatatcttatagtacatagtaggcctataatttattctaggccataactcataggaaaacacacattctacactgtgacaaaaatacatctataaacttacaattaaaacaagcttcacaaaacagtatttccccttacaatgtgcaatgtacaaatgctggttattcaactgtttttatttcccagcgatgggctggatactgatgtgttccagatctgctgcatcagcagcacttaacgaggctggcacagaatacgcattttaatagatacttgttgaaagaatggacttcagctggggtcacagcttaacgaaaactactgatgtcttctgactatggtcaggcagaaaaaaactaaatctcaatgtcaagccaggtaactttgctttttaatccactaatcttgtagtaaccaatggagaacaggaatgaagcactgactctgtagatgacttctgcaaatgggtcattagagaccaccaacgccctcatccccttgctttgttaatattcctggtgggaagaccaaagggtcttgctcggtcatcagaataatgcaaatttctgtatctacaaaaagagtccttgtggaaacccattcctctaaaatgtttctacatttgcatggaatggtaggatgaaaatgacaaaatgtcatggttagctaatcccatggtgattcggaccaaaggcaaaccccaggtgggcttctcagcattttggctgtgacttcacaccctaccttccaccgaggcatgcaatcagaaggcttccagtgacctccgagcttgatggttgggtctttggagaagagttcatgaatgtaatccattccaatttcactcatgtttatgtctattgggccctctgaacagagacggggaaaagggattaagaggtcagaaaatgataggtttccctatgcctggggttttagtctctggagagcgcaatgctttttcagctgaatttgtttttagcaaggatggaagtcccttcctctgctttccatctcaccgtatttcagttcctcactattttcaaggtgaagaggcaaatcaaggaattaagactttagagttctgcttctgtcaggggccaggtagaaatgaaaactttaagtaaaacagtagctgagcttttttttttttttttttttttttttgagacagtctcgctctgttgcccgggctggagtgcagtggtgtgatctcagctcactgcaacctctgcctctgggttcaagcaattctcctgcctcagcctcctgagtagctgcggttacaggcatatgccaccacacccagctaattttgtatttttagtagagatgaggtttcaccttgttggccaggctggtctcgaactcctgacctcaagggatccacccacctgggccacccaaaatgttaggattacagtcgtgggccactgtgcccagccttcttttttttttgttttgtttattaatatgttttaataaatagagacagggtctcactatgttgcccaggttggtcttgaactcctgagctccagtgattctcccaccttggcctcccaaagtgctgggattatagctatgagcccctgcacctggctgcagctgagcttttctgagaagaaggagaaaagcagctgagcttagagtcatgtcaggtttgctcctgatgcaagtgcagccacactacctctctcaatccattcaccagtgggtcaggaccctgagtgattatgtcctaactcagaatgctggtcatctctgacttaagtcaggaagtggtacagtaacaatcaataaatgctactgaaacaatgaactaataacattagttttaggcctgtcaacgcctatttctgatacacaaatctcagccttcccaaactaagcttacatctagatgcagacaaatgcaggttttaaagggaaaacctatatatgtgtggtgagacatgcaaatgaaacagtaaggcttccaacacaacttacatacttataattaattattcatatatggatgagaatatgttcaaataccatgcacgactatttctaacattttccctattttcactatatttgtgcataaaagtcaactttgcaaatgtaagattttccttttcttgatctcacttcttaaaaaaaaacaattttaaaaaaagaagtggggaaccatattaagaagcctaaaagtataggaaaggtataagagtttactgtccttgttttagcttacacgagattcaaaaaaaagaacaaaaagatctaagaattgttttaactagcactttgttaagaaaataacttccaagcaaggcatggtggctcatgcctgtagtcccagcttctcaggaggctgaggcaggacgattgctccctgaagttggagaccagcctgggcaacatagtgagacccccacctctaagatcaagcactacaatcagtgagaggtttatactaaaaagacaaagctgactgcctatacagtgatgtgctttgacattttcaccagtgacggatggcatatacggtggttgcataagatcacaatggagttgaaaaattcctactgcctagtgatgacatagctgccatagcattgttgtgttactcaagtgtttctggtgatgctggtataaacaaatctactgcattgccagtcatataaaagtgtatcacaaggctgggagcagtggctcacacctgtaatcctagcactttgagaggctgaggtgggcggatcacctgaggtcaggagttcaagaccagcctggccaacatggtgaattcccatctctactaaaaatacaaaaattagccaggcgtggtggcagatgcctataatcccagctactcgggaggctgaggcaggagaatcacttgaacctgggaggcagaggttgcagtgagcggagacggcaccactgcactccagcctgggcaacaagagcaaaactccctctcaaaaataaaaaagtatagcacatacaattatgtagagtacattatactagataatgataataaactatgttactggtttatatatttattatactatatttttaaatcattattttacccttttgaaacagggtcttgctttgttgcccaggctggagtgtagtggcacgatcatggcacactgcagcgtgttgcccaggcctaggtgggagggttgtttgaggccaggagttcaagaccagcctgggcaacatagtaacaccccatttcttaaaaaagtaataataataattttaaaattagccaggcattgacaacaggcacttgtagtcctagctcctcaggaggctgaggcaagagggttgcttgagcccaggagttcaaggctgcagttttttttaaaactttttacaagttcacaagtttagaaagtagaaaggtataatagtaaggttcatctaccattaaagacagacaaatattttctgaataaatttggtgcagccaaagtgttcagtgttcataaagtctacagtagtgcagagtcatgtctcaggccttcacgttcacattcactccacgttcactcactcactgactcaccagagcaacttccattcctgcaggctccgttcatggtaagtaccctacacagctgtaccattttttatcttttatatctcattttttactgtaccttttctatgtttagatacacaaatacttaccattgagctacaattactgtatagtaccatgctgcacaggtttgcagcccaggagcaataggccataccatacagcctaggggtgtcgcaggctacaccatctagatttgtggaattttactctaggaggttctcccaacaataaaatcacctaatgatgtacttctcagaaagtaccctcgttgttaagctatgaatgactgtattcatactttctctaggaagttcaaacagaacccaagttacaaaggacaggcaagggcaaagggaagagtgaaaaagtaggaaaggtagaaaatggcacccaagaacacaggcaaccttgcagcaggctttgaagaggagccaggagcacaactttcacaaaccctgtttccaatggcagggaggtatttatattctctctgcaggcagacagagagatcaagagtgccctcccctttatccattttaaaagcagaggaagacaggccagagctgtactcactcatggaagggagtctttcagggcaggtatggtttgcaaagtaggtgaagtcttcaggaagaaatgttgtagtttgcaggaaggtttcactgtggttcaagtcaagaggataatctagggaggtaaaggaaaaaagtcgatcagactggtatgtgtgatcaaccgtgcaattatcagatgcctaccaagtaagtctttctcttagctatcatcttggtagaaggagacaggactctggactaccgctttgatgcagctaaaaatgtgaacccatcaataaaaatgtcagccaaatggcagattttaaccagtgttcctattcctattgattttataggtttatatgcagcactcagtttacagtcaactgtaattaaatgtaattttaaaaacagcagttgccctcctctcatttctgttttctaaaggaaccacttgcccttcttttggccaagtatctcagcatttatatgcagtattcacctctgtcagcctctacggctggtcgtgatgtttctgttttcagtcttacctaccgacctcccacttatccccttccttctgccacccctgccacacgatccccttccattccccagtctcccatcggtcacatatcatagctgtggttaggacaatcttcagtctttgtattacgatgctgctgttaagtactagtcgtcgctgagaaatgtggaaagttatgcatcttgtttttctgtttgctcagttttatatgcaatgattctaattcaacaccacgcctttcaccaagacatttcctcctaagacatacattaggtattctctcaacttcatcctcccagaggaggtgtggcagcttctggccttcttccatgccaaatgtgcttggggggaggtattctctcggtgatgattcctcccttctgtactctgtgctgcctttctggagaatacagaacaggagttggatgtgagacctcccagtcctctgtctcatcttttctatccagttttccgtcttgccatttatctgccctactttccaagagatttcctcaactttactcaaccttcctttaatcatcatctctgctatcatattttttaactttgaagagctcttgtttcctgaatgttcatttcttactatattcttgtttcatgtttgcagtcatttttctcttattggtatctccagtgtcaatatctttgggtcttttctcctggtctgaccagattctccagagaaatccactcgaatctcctgccagaatggtagagtcctgactataaacatcctgaaactaagaaagaagagaaagaggctggggcatatgtaatccccatcttttcaaatactgtggtcatgccaggtatccccaggttgaggagcctctgttttgccatctctggggttattaagtctccagctcttgccaggatggggaaatgggtctgggtatctgactgctttttaacagctttcaatctccctttattttagttgccacctttgctcctacttcccatattgctagttcctgagcttctgggggatcctggggtggttgctggttctcctgttgctgctttgagcagtcagttttcttgggtttgttaagtcttttatcagtggttcttctgctttctacctaccaaggttttttgctgtggtctccttttgtgttctcattctcaagggtttataatttaaaaaccctcacatatgtatgcccctttagagtcacgttagtggatatgaagagtgtgatggcagatgtctttttcctaggggactgtacttgtagagtaggaggagggtcctccaacctcattttctacagatgaataactggaacaacatacacagaactcagaccaggagccctggctaatgcatgacagagctccaactaaactctgaatgagagatccttccagtatactgtattgtttttatttttttcacagaatattaaatccttttggatccatgctgattctatgaaaattaaaacatcctgttcaaattcactttgtaccctagaattctagaatcttcaactaagatatttttgaaaaagcactatgagcaggtttccaagaatcaaatggctaacacattgaatccttttatatatgcacacggctgcctactctgcgctgcctactctgcaagtactctggggcaaaattcaacgagaggcaacttgaaaattttaactgtgtcttaacaagggaaggaacagaatgctttctgtccttttcagtagtagctttcctgaaaaacactaagcctgcatttatagagaatagtagagactaatttatataaagacataaaccaggctgggtggggtggctcatgcctataatcccagcactttgggagactgaggcaagaggattgcctgagcccaggaggccaagaccagcccaggaaacatgctgagaacctgtctctacaaataattttaaaaattagccaggcctggtggtgcgcgcctgtggtcccagctactcgggaggctgaggcaggaggatcacctgagcctgggaggtcgaggttccggtgggcaatgatcacaccactgtactccagcctgggtgacagaatgagatcctatcttaaaaaaaaacaaaaacaaaaacatgaaccaagacagaaccttaaagataatatttacacagaaattctctgagctcagctcatacatgcaaacctggcctgggttgaatcttcttctgaaggtagtaactacttcaaaaatctatgtgaagaacccctcatcctaattattactcaggatgaatctaatagatgaaattattctcctttagaaaaaaattaaaagacctcacaagtaatagaaaatgtgcctgtgtttgtgatacgcccatgtgtggcaagagacgctggctggaaacatgtattggcacagtcaatacattcactagaaggcaatgaaattcccaaaagtattacactaagtatattttcataaacaaatcaacaaaaacgaagataataatcattctggtcaatgactgacccaagccctagagctagaacctaatcaggaaactagaatttaaaaaacatgaggcaagagacaagatatcactaactctaatgattctactatttggagtttctttgaagatagataaattcctttctacttccttcaaacaatgatacagtaagcctggtagcacctagcatgaaacaaaaaaaaagcatttatttttcttctgattactaaattaataatatgtcactgttttaagaatcctcaaatacgcaacaactctattgcaaaaatcttccagaaacttactctacatcttgggaggggtggcttaatttcctgatttcttgtttaaaaatttttaaataaaactttaattaaaataaagtctacttggaaggccaaggtggggtgctcacttgaggtcaggagttcgagatcagcctggccaatatggtgaaaccccatctctgctaaaaaaaaaaaaaaaaaaaaaaacacaaaaattagccgggcatggtggcaggtacttgtaatctcagctactcaggaggctgaggaaggagaatcgcttgaacccaggaggcagaggttacagtgagctgagatcacacggttgcactccagcctgggcaacaacagcaaaactccatcataaacaaacaaacaaacaaagtctgcttttcagtagcaatagaggccttttaaaatgaaagagacagaggaaattaattgctcacgacctggtaaaactatgtgcagttatcgtgaggagcccttgtttttctcccctgctagctgtccagcaacgggtggggttataccttatccccttggagttccaaatataacttcttactcttctaaagcatgtacctactgaatgaggaaaatgctgagagaaaaacaagcctgttgaatttctacagccacagttttactttttaatttaaatctaatctatttcaaacctggacatgttcttgaagggcaaagaaggcagctgcttttacatttagaaaatggaaaaacaagccgggcgcggtgatctctgcattttgggaggccaaggcggatggatcacccaaggtcaggagttccagaccagcctgaccaacatggtgaaactgtgtctcttactaaaaatacaaaaaattagccaggcacggtggcatgcgcctgtagctccggctactcaggaggctgaggcaggagaattgcttgaactcaaaaggtggaggctgcagtgagccgagatcccgccactgcactccagcccgggcaacagagcgagactttgtctcaaaaaagaaaatgggaaaacaggccaggcacagtggctcacatctgtaatcccagcactttgagaggccaaggcaggtggatcacctgagttcaggagtttgagaccagcctggccaacatagtgaaaccctatctctactaaaaatacaaaaattagccaggcatggtggtgggtacctgtaatcccagctactcaggaggctgaggtaggagaatcgcttgaacctgggaggcagaggttgcagcaagccaagatcgtgccactgcactccggcctgggcaacagagcgagactccgtctcaaaaaaaaaaaagaagatagatagatagaaaatgggaaaacaacagactcctacctacaggttcaaatggctactgatatcatgggcttgcagaccaacatttctgtccaacagcaactgcttattcagcattgcttcacaccagtggttcagcagccttggttgcacattggaatcatctaagaagctttcaaaaatcctaacaccaggccgggtgtggtggctcatgcctgtaatcccagcactttgggaggccgaggtgagcagatcacttgaagccaggagtttcagaccagcctgggcaacatgatgaaacctcatctctactaaaaatacaaaaattagccgggggtggtggcacccacctggtgtcccagctactcaggaggttgaggcaggagaatcacttgaatctaggaggcggaggttgcagtgagctgagatggtgccactgcagtccagcctgggtgacagagcaagactgtctcaaaacaaaaacaaacaaacaaaattctaacattcaggctatacctcaggccaattaaataagaatcgctagcagtcaggcacagacatcagtactttggaaacgtccttgggaattccaatgtatagctaagcttggtattgctaccctaatacctggaggaggtaaaaacctgccttctcccttgtgttaccaaatccagttgagaaggaatcgaaagtgctgaccaatggaccccagcaagaatcaccactttcccctcccatttgagaaaagaccaaacacttgcctctctgcttgaaaaaaatatggaaatttatatatactagaaagatgccactgggacaaatatctgtgaaatataaagaattagcattcttcaagagttagtccattaaaggatgactacctactgggagggtagccacatcgaagactacagactggacatctaaaaccaccgagaaagaggtgaagatgacccactccattaatagattacaaagcacaccagcatgactttactcactctgcagattcacaatctcacaaaccaatggctttcagtgacaacaggaagcttctcctggtcaccacttcaggtttatttccaggttcacagaccccatccccaaaagtctgttttcattcactaatcaccatgttgcttttaaacttaaagaaaaccagcatgacttaaatgtcaccctgggcttttgagctatgcttggcctaatgcagatgcctgaatgtgggtatgtgcctcagcattatttcagcagaggatggtgcataatccaggttaccaccattaagccaacagtgctccaggcagaagtggtcgggccagaggtgtcagtcatttggctgtctcagcagtgctgggcccagaataccctctctgactgtgctaggtagacaactgctttgaaatgaagaagaatgatgggttttcattaaatacactttcagtgaaatgctattttcttttcagtacaggttgagtatccccttatctgaaatgcttaggaccagaagtgtttcagatttctgattttttaggattttggaatatctgcattatacttaccagttgatcaaccccaatctaaaaatccgaaatctgcaatgctccattgagtatttttttcaagtgtcgtgttggcactcaaggtttcatcatgtgtggattctggagcagtctggagttggtattttctgattggggatgctcaacctgtacttactcgccaaagatgtgccagtgacacagcagctccacaagatggtgacctccttagaaacatgctacaacacttaagacgtgctttcttgttaaattcattccttcatgcatacaaaaataacttaccaagtgcttcctatgtgcgaggcagtgtataaggtactaaggatacaaagatgacaaaaggaatgaagccattactgcgattcagggcacaggccctggagtcagagaatcagcaaaccctaaccctgctgctgcatcaagttccatgacttccatgtgccttgttccttttatccctacaatggggacacagtagctaccttctgggttcttgtgagggactacatgaaatcatgtaagtcaagtatctaataaacagtaagagagtccctgatggcacagacttccaatctattagagaaataaacacgtttaacaaaaaatagattgttctaaccagagagatgcaaggaaaaggtatttgggtgtatgataatttgagaataaaagtacaccaagttcaataataacgggtcactggatacaccctccaagggtgaaactcacctctgtactcagttttcaaagacagcaactcaggaagtagcgcaatcctgtgttgccagaccggcagtggtgtggaaatggggtcctgctgcatgcccctctaacttctgagagaactgccagtactgccaaatgcccagagagacagatattccagcctcatctaacactgcagaagtatgacatctggactggataaatgtcatgaggacacaaatgttcccttactcagtgctatacaggggagagcgctctggaagggcagtcagtactgcctcgtttcttcacctaactagaagcaggattttggcagggtttagggaaagagtcacatgatcaagctgcgccatcttccccaagattatatgtactatgtgtgaaaaatgcaaacagcataaaattctgccttaactgacagagccacatgagtcgagtgagaatgtgtgtgcggattgtgcaaaacctaccaccacatgcaagacggaaactgcagggtttcctctcccaggtatggttcagagctcaggtaacttgacccagtgcgaccacaatttgtctaaaaagctctgaaatgtcattcacttgttctttgccaacaagaaagtatcaaaagtttatcagtttgctaactacagtcctctgttgctaaagtggacggcaaaggaaactgataaattaggatgtggtcaattcttttaaggagaggcaattcttttaagagaggcaatgttttctcttgattttctaagcgccacagaataattcgcatttgcaacatttgcaaagcaatttcacattcgacagtgaacttccaaaaatcttgtaacttattagagaagaagagaggactgatttagagggagaatttttttttaaatgtaagtattttaaaatattgggcttagacgaaatcattaagaagccataggaggctgggtatggtggctcatgcctataatcttagcacttcgggaggccaaggcaggtggatcgcttaagctcaggagtacaagaccagactgggcaacatggtgaaagccgtgtctacaaaaaatacaaaaattagccatgtctacaaacaatacaaaaaatgagccacggtggctcacacctttaatcctagcactttgggaggacgaggcaggagaatcacttgagcctgggaggtcaaggctgcagtgagccaagatcatgccattgcactccagcctgggagacaaacttagatgccatctcaagagaataaaaaaaaaagctcgggcacagtggttcatgtctgtaatcccaacactttgggaggccgaggcaggcggatcacctgaggtcaggagtttgagaccagcccggccaacatggcgaaaccccgtctctactaaaaatacaaaagttagccaggtatggtggcgcacacctgtaaccccagctactcgggaggctgaggcaggagaatcagttgaacccgggaggtggaggttacagtgagccgagattaacaccactgcactccagcctgggtgacaagagcaaaactccatctcaaaaaaacccaaacaaacccagaaagcacattagtcctcagttacagaaatgaggcgaatcatgaatccttagtaagatgaaatctcagaatctattttttaaataaaaaccatccctggctggactagagaggcctcaagagagtcccacttaatcatgtggaagtattacttccttcctgtattcagtttttgaaagagttgaaaagaaagagccctggcacagtggcttatgcctgtagtcccagcactttgggaggccgaggcaggcagatcacttgaggtcaggagttcaagaccaacatggccaacatggtgaaaccccatctctactaaaaatacaaaaattagccaggcatggtggcatgctcctgtaatcccagctactcaggaggctgaggcacgagtatcacttgaactggggaagtggaggttgcagtgagccgaaatcacccgttgcatgccagcctggatgacaggagcaaaactccgtctcaaaaaaaaaaaaaaaaaagaagtagtcatccagtcactcttaatgtattatgctatagtttaaatgtctgtcccctgcacacctcatgctgaaatgtaatccccaatgatggaggtggggcctacagcaggtgtttggttcacaggggcagatccctcacaaatggcttgctgctgttgcggtaggttctcctctattagctcccacaagagctggttgttaagaagagcctggccctgccctcctctcacctgccacattgcttcctctcaccatacacacaggcttccccttccccttccaccaagagtggaagcagcctgaggccctcaccagaagcagacgctggcatcacacttcttgaatagtttgcagaaccataagccaaataaatcctttttctttgtaaattatccaacctcaagtactcttttatagcaacacaaacagactgagtcatattgttaacaaaaatgaacgaggattcatttggcaagagcttttttagcagtaaagtaaaactcagccaaatccctcttttacaatgcgcttttcccattgaaaataattattgcaaccgaatttacctctcttgggaggagacattctaatcagaccacctctttactaaaaatatacctgagtcatttacactgctgttcctcttggcataagcactccgaagcacctgctcataaacctgagcaccgattgttctcacgttgtcccggatcagaatgccttgggcttgcatcatgaagaggtaggtgttcactgcagaaagcaaaaaggggaaaaagaggtggattcagaagcaatcatttaaaaaaacataccacatagctatggatttttttttctttttggacttttaaagcctcttttagttcttttaaaaccctacatgaccataactctattttccatacctttcaggacaccaacatcttttgggtagctagtagagcttagaggaatttctgtcaatatccaacagttctagaaaaagcatcaacttaaaaaaaaatatattccatctcttctccaaatacccaatctgtattctagcactctgatcatcagaagaaagacctttatgaattagttaaaactttttttttttaaaggtttctgctctctttaagttcaccttctcagaattagttcatggttcttcatagagaaaagaaaccactgactctctgactgctagaagcactgaagccatggtctgaagccacggtctggtcttggcaaccttttcaaagtggtagactgaggctccaatcacttacccttgggagatttggaaagaaaaaggagtaacgaaagactatttgcagtcctcactatccacccatcccagcccaaaagtccaaagcaatagggaaagagcacagtccaaggtcaattaaaacatgctcttaacaaatgagtgttcagattaacctgccaatcttgtcttctttggaaagtgatctccacttgcattttcctgaagtctctctatgatacaaaactagaagctcacaaacacgtcaaaatgtaatccctatattctacttgcaaactccactgctatgccatctattttcaagaaacagtgagattgtaaaacatagtttcttaaccagtcactctaattccctcaaattgcctttgtcattgtgaaagggggatgtgttacaggggtggaacatttacaaatctaaactttgtgggtgtctgggggtggattcatctaaccgcttggctaacctcgggaccaggccccagtgcctcctccacactcaatacatctggccttgggatgtggattccggctctttgacaaaacacttggctgacattaggtttcatcactattaaagcagtatcctgtacataatgcgcagcaaacaatgactgaatggaataatggacgaagcttagaagtcactgtatttcaagctagtgcttttggtgctttatactgggaatgacagaggtggggtgggttagcataatgtcaaaaaccccacgtggccaacattaaacagggacattgaaatctttcgaaagatttcaaatcatctcttaaggtatatcccaagccataaaataataagcaaaaaggaccagtgttcagaatgctttccgaaatgagggagcagtttcaaatgcggccttgcattgattgggagacagccctatgcttaacttctggcaccgtcggagaatagatcagatattgtgtttattctctagtagctaggaaagattttaaggaaaaaagacagcttccaattattaaaaaaaagtataactgtgtgaagtctctgaaagcaggagtaacacctcattctctatttccagcagataggacactgccagtcacagtaggggggcagtccacaaatacttgttaaacctaagacttaaacttcatctaatatcacatttctaattcagtcctgtgttgttgttgttgtttttaatcatttgggctgtgcagtatgttcccactgccctgaaatcttcctttcatcccaacatattactaaaccagttgtcttattgaaaattttgtgtaaagcttttattgtatttattgaaaatcttgtgtaaagcttatagtaaggtgccgccaagaactcactacctcctttcctctgcactgcaaaggacacagttgcttagcccctcctttaaacactctccctttcttagctttgcatcccaactggaggattcctctagggcagtcattctctaatgtttcccacccatcccccagagtgcttttaagaagcctgtttcctaggtcccactacccagactgatgcatctggtctgagtggggcccatgaatgtgcacttgtaacaagctcgcaggtgataaatggtgctggactaaggaccacacttctataaccactgctctagggaactctggccacataataaatataagcaacatttattgagtacttaattacataattccttactgcatttaatcctcataattatcctaagaggcaagtaatactatccaatttacaaacaacttctaggcttcagtttctccaagtatcttcacaaaggtcaactgagagcactagaatttgaaccaggtgtgtctgtgctcttaaccactaagcttttatacctcactcatccatgttctagccacaacctctctctgaaagatttcaagcacccacatggcttaaatgcttactcttaaggagatagctctcacatcttcatctcctgcacaaagctgccagatggatctttcttgacctttcttaattacagatttatccacactgttactgctcaaaagtcttttacgtctcttgcctttatccctgagctgctgctacagcaaggagtctattctttctgccgtgcaaatcccattaatccttcaaaccccagttcacagacctcttgaggaagctttcagtaccgtgtcagtctccccccttctccagtttctgtgatggtctattacagactatcaaaacttggatttgtttccatgttgacttaattcactaacaactgtctcgtgttagtctcgtcattcaactaataaattaacgtaaaccacatagtatttttttttctaattatcgaaaggaactagcacaatgctaaaaaaataaaaactgagggagtaaagattgccaaacaaaaggaaataatcacaaatccacaacttgggattggatggcattttaaggaacactcaccaatatcatcgaatgcttcccactactggggaactatgacctccaagaacacagagtcaacagggaaaatatggccatcagcaaagaaaacctactttggttgggtacaaaatgtttcccagtcacttgttttttctttttttcttttttttttttgagacagagtctcagtcttggctcactgcacctccacctcccgggttcaagtgattctcatacctcagcctcccaagtagctgggactactacaggtgcatgccaccatgcctggctaatttttgtatttttcatagagacggggtttcagcatgttggccaggctggcccagtcacttttgcccactggttctctctcaaccttccccagacaccctctcccactcaggccccttctatgtgtgcccctcccatatcacaacttcacacaacttcacatcttcatcatcacaacttcatcatcacaacctcactccccatccaggctgcgctctctgcatactggcccagttgtctacacttgacaaagagttgtgaccacactaacggagttgtccagatgcaataggatgagcctagaaacacacaaaccaccagcagccctgttccacctgttaccaaagatctgtaaaagcaagcccctttttggagattcacaatgcacaataactcaaggcccagaaattcccagaagagagatgtttagttatttagcctgccatttcccaaaccagaacatcaagtgagtctctgcagaacttactttgggaaattcagttttggatatttctatgaatagactttttaaacgtccattacatggttaggtaatcaatcaatcaatctttgctgaatgttgttggtaaacagcagtcacatcctattactaattcatatcaagcttgctagaagcaaaatccccttaatctttttagagatgctaaattgcccttctcctgtgcaatgctcatgtagttggttatacaaatcaaactgtaggacctttcaggtgtctctattaaaagtcttgttaccggttgggcgcagtggctcacatctgtaatcccagcactttgggagtcggaggcaagaggatcacttgaggccaggagttcaagaccagctgggcaatacagcaaaatcccgtctctacaaaaatagattttaaaaatactagccgagtgtggtagtgtgcgcctgtagtcccagccactcactcagatcaaggctgcagtgaaccatgatcgtgccactgcactccagcctgggcaacagtgagatgctgtttggttaacaacaacaaaaaaagcagtcttgttaataaacttaggccatggctctggcctaaagtaggaagtacatatgcatacacatgttgctttcaatctaaattatctcattcaaaattcacatctctgtgaagtagatatcatcttgagtgtttattttagattaggaagtcaagtcctccagggggtaatttgcccaaggtcatatggttagagaaatcaaaaccagagaggtgaactgagttgctgcatatattttgatgagctttactttgtttttttctttttgttttttggagatagagtctccctctgtcgcccaagctggagtgtagtggcgcgtctcggctcactgcaacctccatttcccaggttcaagcgattcttctgcctcagcctcctgagtagccgggattacaggcacctgccatcatgcccagctaattttttgtattttggtagagatggggtttcaccatgttggccagactggtcttgaactcctgacctcaggtgatctgcctgccttggcctcccaaagtgttgggattacagacgtgagccaccgcacccagctaactttgaaaattctgaaagcagtactttctaataatatggtcctgcgcaacagtggctgaatcacagttaaaaaaaacaattttaagttggtgtgcagtggttaaatcctccagtttcaacgagtctctactgagcacctccttcactgtgtgcttttcaggcaccgtacgagggcactggaggccaagtatgcataaggcaacgctgaatagatgagtaatgtatagacaaaattcaacaaattacaatgcagtgtggtaaatgcgacaacatttaacacaaattcacacttactaataatttgttttacactttcatgagacaatgtaattattatccagcctcatatctaggaggagggatctcttatatataaccataattcagttgagaaaaataagccccattcaggtctacacaattagaaatttccattcagatgccagtgttagcagccttgggccatggcttaactggacagcttccgggggcgaaggactgggtttcctgcccttcagccacctcttggccacacaatggtgcctttcttcctctctgcttctgattctaacaggaaaacctcctcctttctcactgaaccttaatgtgtatccttaatgtttgctgtggttggcttggtaagctaaaagagggttcagaaccagaaaagaaaccattcccttcctgaccactttttacaatctgtatctcacccccaacatatgcaaacatacaacacacacacactcacacccaaacaccaatcaccctcctctgctttggttttctacttaacatacaacatattttaaaatttatcttgtcccccataagaatgtgagctccattagggcaaggctgttgcctacttcctttaatgctgtacccccagtggctagaatggtgtgttgggaacacagaggatgcataataaatatctgaatttaaaaaataataataataagttgagacaatatagagttttctgaacttggctgtgctccaggaggcatggagatggatttcaagcccttctctttattttgcattagccccctcctcctttctgagaggaacccaaaatactgtaagttaaccagtttcactgcactaacctgttcctaagaaaagctcagtcattcctttccaccaattgagcagcactgccaaaaagattagctttccccccaaaatgttctgttactctcattcctcataaagcttttaaaaacatgttccatactataatgcacaagtttattcaaaatcttgtgcaataatatttgtagtagaaaaacactagggaaaaaagcctaaatgaccatccaaaggagactggttgaatacatttttatactcactcccatggatgagtaccatgagaccataaaaaagaatgagaaaacatttgttatagtccaaaactagaaagaactcagaagagattaaatatttgtagcctattccgattttggaatactatacagcaacaggaataaataaactagaactgcatgcacccacgtgaatgaatctctcacactttatgtgacacaaagaagccagacacaaaagaacacatgtggtatgattccatgtagataaaatacaaaaacaggcacagctaatctacaacataaaagtcaggagaatggctaccctggagtgcaggagagttgaaggtggcttctggtcatcttatttcttaacctggatgctggttattcagatatattcattttctaaacattcaccaagctttttgcttacatgtacacattttaatgttatatgtcaacaaaatttaccttccccaaaaataaggtgagcaaaacccatgaattgacttccaagacatattatgctacttaataaagggaaattgatatgcactcacatatttttacaaaaaaaaaaacataggaagagtaaaccagaaactaataaaaatgaaggggtaggactgaggcctgagtacaccttttatattttggacatttacgtattaaaaaaattatctagctgggcatggtggcacacacctatggtcccagctgcttgggaggctgaagtaggaggctggcttgagcccaggagtttaagtccagccagagcaacatagtgagaattcatctcaagaaaaaaaaaaaaaaaatatatacatatatatatatatatatatatatatatatgaaaaatgggcaaaccctaaaactaaatacaaacacaaacaaataattctaataatacattgtactgaaaacacaaccaacggaaaagtactccgatacattctttgagagatatactgtaaggacaaaaagaaccgtaaagaatctggaactctgtttagcaggtctgttgattacagtcatatttgggtcataatcatgacatggaaatcaatggatgctaaaaccctcaggtgaaagggttgttgaagaggatagtcaaaacacatattcaatgcaccaccccacaaattacatgttgatcacaactgacatttgtaattttgctgcataagaggaagatctagcaggtcatccctttaccaaatgtctcaactcagcaaccccaatattagaacaacctacagttccaggctcctaatgcaatgtaagatatttacttcctatataatattcttgctaatctactgaagagaaaacaagaagataaatctagaatatcccttaagagttgggatctcactctgtcacccaggttggagtgcagtggcatgaacatggctcactgaagcctccaactcctgggctcaagtgatcctcccaactcagcctcaggaggagctgggaccacagcggaatgcccccacacacagagctaacatttatatttttttagagatgaggtctccaaatacacacacacacacacacacacacacacacacacacacacacacacacactttagattcttcaggctgaaagaacataggatattctacaaaataactgatctggaccaaaaaaaagcaggggctattctagattagagacataactaaacgcaatacatgaactttgactaaattctgaatagaaaaatcagagtgctaaaatagatatttttgagacaagtgagaaaaattaaacatggaatgtatatcagatattactaaatgttaagcttaagtgtaatcatagtgctgtgattatgcataatgcgcttattctcaggagatgtatattgaagtatttagaggtttcgcatcatgatgtctacaactttactttcaaatgcttctgaaaaaaatgtgtgcatatgcacatatgcatgtatgagcttatgtatgcatataaaaagttaaagcaaatgtgacaaaatgctaccaactggtgaactcaggtgtagagcatatatttattgtactattttctcaatgtctctacagatttgcaatttttttccaaaagaaaaataaaaggttgttaattaatgtgttgcaactgccaggttaagtggcttactgttctgctggacttcaagctttctccaaaaggggaaaagtaaagtggccacttactctccaggagtggccaagttcccaactttatttaatgaagaaacagagctgggcacagtggctcatgcctgtaatcccagcagtttgggaggcctaagcaggaggatcacttgaggctaggagtttgagaacagcctgggctgttcctagtgaggctctgtctctacaaaaaaatttaaaaatcagctgggcatgatggcgtactcccaagctacttgggaggccaaggtagaagaatccttcgagctcaggagtttgagctgcagtgagttatgatcatgtcactgcactccagcctgggtaacacagcaagaccctgtctctcaaaaagggggggtgggggggtagtagtaataataataataataataataataataataataataataatgaagaaacatcaagtcctaaggactttttacacttctataaaacaccagctacaaagagatgatgaattcttttataaatgttacaaactgtaattcagacatacattcattcaacactcattatatacataagatgttccaggactgccctatactctaaagataaagagatacaagtaagacacagtccctgccatcaccttgcaatggaagaatagtcacgtttgttcaggggtacaggagagtggctactagatcatattgggagcaggggccaggaaaatactctcagaagaggtaattctagagtatggtcctgaaagaagagcactgaagcaggagagggagcagcataaatgaaaacaaagagccatccagggggaaatacatctgaggaatcaaagaagtttcatatggctggagcgaaggttgcatatggcaagaacatgagacgggaggctagaaaaatggggggagcaagagcgaaagggcttcacgcactatacttggggtctgaacttgattctgaaagccacgacattgcagaaacggtccaggattggatttccagtgggccaatgagtaggtatcaatcggaacaagtaaatttaccctactcaaaattcctggctccagattaaggactgaactttttagtatccacatctaaattcttagatgaactaaataagattctgtgtgtagaatcccccaggtgattaataaaagttgggagcctgaatcttagcaaagactgtactttctacatggagcaatgcagaggaacaccacatctccatggcatgtagagtggagggaaaatgtcaagatataaagctagacacaactgaccagagccagaaagaatgacactcagcaaaggtgctgcttggtgctcaggggggtctgttagactgggttttctttctctgaatttactcacatcatcatcccactataaaatgtgggatttataacagagtcaaataaattccagaaaaacactggagccaatctatggatcacaggttctacctctttagcatgtccatgcttttggcataaagaacagggaaaagggaagagaatctaaagagaagagaagcagaaaatgaataaatagaacaggaggctccctctcacgctcatgcttgctagtgctctctccttcccccatatacaaaatacacagataagacacaataaaaattaaggaaaaacaaaatgtgccaaaggaatgttgaagtttgatttctgccatgctagagtatctgcaaaacctgcattatctttttagaccaatattttgtggaaaaagcacaacctgaaaaataattcaaccttacccccaaacaagcagatgatcagtgttcactgctctgcacaacaggtaaagaaagaatctgcttattctgcttataaagagatggattcctatacaactaataatgcatttattgagtccttatgtgccagcacctttccaaatgcctgtgttttatctcatttcatcctcacaataactgagaggcaggttgttaccatcaatttagagatgaaaaaaactcaggtctgaatacgcaatctgaccatgtggagccaagatttcacagcaggctttgtctccagagtccagatttttaacaaacatgctctactgcctctcagatgctcaatcccctgaatccacagctactatgctgcccacactttgtttgattccttttacttggatctttttgaagtgtttttttttttttggcttgtgttgttgttgttttttttgagacggactctcgctgtcacccaggctggagtgcagtggcgcgatctcagctcactgcaggctgcgccccccaggggttcacgccattctcctgcctcagcctcccgagtagctgggactacaggtgcctgccacctcgcccggctaattttttttgtatttttagtagagacggggtttcactgtgtcagccaggatggtctcgatctcctgaccttgtgatccacccgccttggcctcccaaagtgctgggattacaggtgtgagccaccgcgcccggcctgttgttgtttttgacaggatcttgctctgtcactcaggctggagtgcagtggcacgatcatggctcactgcagtcttaacctccctggctcaagcagtcctcacactttggcctcccaaagtgctgggattataggtgtgagccaccccgcatggccaatattacctggatctttactgtcaacatgtcatatatttcaggcttccaatattccacttcaggagtgggtgccaatactcacgctataatgcatcccccaaattttataagtttgaagctctaatgtgaatcatgaatttttccattttaaatctgcttaaaatgctggatactcatactatgcattacatacattaacatacatttaagagagaaaatacagcttttttaagatacaaggaatttttggcagcaaaatttacacccattgtcttatctatttaaatattttggagcaaccgtgtgacaattttcatacaaaaagtgtttaaagagaactgggaggaggggggacacatacacacattaacaaagtaaataatacaaaaaaatattttgggggaaaaattgatttgaggaaacttttgctttcctaatccttctcatttgaggcagaaaaatcacaaagtcattcgtaggtttcatttttcaccctaattactattcctagctattaaaaaaatccaagtggtaaaaattaacagctatgaagtaccctataaacatttccactgacctattagtctaccatctgttaaattattaaactgtacataagattagacatgaaaatgctgtctaaacagatactagatggctgggtagcctatggtaagtactttactgatctaagcttcagctttgcttcccccaaaattcttaatagcatgaccagttatcaaccctcagaagtaccaatatccacatgcacagccacataacctcagtataagcttgggtgggagaaaactgtaaattaccttgctggttccattgaaactgaacacgtacacttatcaaaacaaccctgcggagaatgggtgggggtggggggggcgtcagggtatgacggatgttgctgatgggaatgtgctagaggcacaagaccagcactgccacactcctctgtggaactgaaaccagaacaaaggctctgctcccctcacctccgcaccccctcgtcctaatctctgtccgtcaccgcccccactccaccgaccaatccctgtccctgaattgccttgtggttccagcctcccacccccactgacacctcctctgtatgaacgtgcttttgtgacacccgctcatactaagctttttttttagacagtgtctcgtcctgtcacccaggctggattgcagtggcacaaacacagctcactgcaacctcaacttccttggctcaagcaatcctcctgcctcagcctcctgtgtagctgggaccacaggcgtacaccaccacatctggtgaatttttttatttttgtagaggtagaatctcactttgttgcccaggctggtctcaaactcctgggctcaagcaatcctcctgcctcagcctcccaaactgctgggattacatgtgagagccatcatgcccagccaatactaagctttaatgtccctttcctagcttttcctggtatcatcccacccccaagattagaactgcctacacctatctttgggctctttctcaactgatacaccaacttctatccatgacctctacaaatttgagcatgtctctctcttccaatagactgtaagctccttaagagtacagacagtcttattcttttcttcatcaacttctgataaatagtaggcatttagctatttattaaagaattacataggctgggcgtggttgctcacacctgtaatcccagcactttgggaggctgaggcaggtggatcacctgaggtcaggagttcgcaaccaacctgaccaacatggagaaacaccgtctctactaaaaatacaaaatcagccgagcatggtggtgcatgcctgtaatcccagttactcgggaggctgagaaaggagaatcacttgaacctgggaggcggatgttgcagtgagctaagatcgcgccattgcactccagcctgggcaacaagagcgaaactccacctcaaaaaaaaaaaaaaaaagaattatagcttggcacacagatgctgtgatagccggaggagttgccttgcttttttaaggtagaagtatactggtttttctgcaaccacaaaaaaaaaggctataagccagaaaaggtcatagtgaaactgatacttcaccaactgtgctggtgttcgtgcagactggtataaaccctttgggaaaactatttgcaaattcaacaatagccataaaaatgctcataccttctgagctagcaaagtatcctaaatatgaggctattctatgcacaaagtttttacttacattatttctaaaagcaaaatcttgggaaacaactcaaaatcaacaaccagcagctctcagtgctgctctgcctgtggagtagccagtttcttttcttctctaataaacttgctttcacttactaaaacaacagcacataaactgtgacacaaaacttgacggaatcttacacatctttaaaagtgaaaactatgcaaccttatcaccatacaccttatgtataatatttagcatagactatcacatttttaacaacatgaaaaaagttctgctatatcttgacaactattgctaaggaataagaacatgtatcaggctaaaacagacttgaggcaaatttaccaacctgctttgctgttagggagtaacagtgatgtgagatgaccttttttccttctgttttaccaatgttctttacaacagtaatgatttatttttttgagacagggtcttactatgttgcccaggctggtctcaaattcctgagctcaagagatcttcatgccttagctcccaagcagctgggactacaggcatgcatcatggtgtctgactgagtgagggtttaaaagaatgcaattctatagcaaaaagttgaatttcttcaacactgaactgctatctgcctacaactaagtttcttctaaccctttgcaaacatgtaacgtaaaattttaagttgacactacaaactgcttgtctaaatgagtcaaaagactgatacctgttctaccaaagcctcaccaacattcagaggctttggtggaacaggtatcccacaccttgttgatggaaacaaattgatataacctctagagaggttggcaatacagatcaaagtgaaatgttcatactctaacccagtagttcctactttcaggtattcatcctaaagaaataattggataaataacaaatgtgttcaatactgtttatctcagtgctacttataaaagcaaaactccaacctatctatgcaccaaaagggtctggaaaaaaaattatggcaaaatcagaccatgactaactcagctatcactgaaataatgattattgttttagaagtactcactatttaaaaatcataccgtgcaggccaggcacggtggctcatgcctataatcccagcactttgggaggccaaggtgggcggatcacctgaggtcaggagttcaagatcagcctggtcaacatggcgaaaccccatctctacaaaaaatacaaaaattaaccgggtgtggtggtgcatgcctgtaaccccagctactcaggaggctgaggtggatcacttgaacttgggaagcagaggttgtggtgagttgaaatcatgccactacactccagcctgagtgacagagtgagactctgtctcaaaaaataataattttctgagattatgtctgcatttgtgctaaataatttacgctaggagcagtaataaaagcagagatgaagctattgattcaagacggtatatacattgtatatatactacatacagtatatcacatttgtgttaaagacacaaaggaaaatataagcctagaacagttttagaaatcacttatcaagatgttcagtgttttttatctctgtgtggcagaattacaggtcatctgggttgtcttttctttgttacaatgcaacatttccatgaacatcagaaccctgtaagataaggaggttctctgttccactagtgaaaaactgcagtaaccaaatctgtttaaatcaactgacccaaaatttcaaagtttccaaagttactgagaaccccttttcacacagcatctactttatgagcaccctttaggaatgctgcctttgggcagggtctttttcttttcatttttttttaaaacaataatcaataaatttttgtatggggtcgggggaagcacaaaaacacaaccttctgccttagtaagagattcctcccctcttcattgctccagaccctaataattcccctaatctcaaactgttattctacccccaaattatcctaccccaaatgattcataatgatcctaaagctcttggtgcttctagctttaacttcatcaagcaagtttcctctatctagcctaccatccaaacatattcttccacatactgttctttggtctccctcctgattctcttttggaaagattattcttcatgtcctatggggataatatattttaatcacattattgttagcctggaagcttgtaacagactaatgggttatctactcgttgggaatttaagtgcttccaagaaggcagcattccaactggtattaacacccaaactgtcaaacataggaaatcagagccatgctttccataaaaaggcaaaagatgccagagaaagcacttgaaaatttctagcttctaaggcacacacacttagcaaaacaaagtctttccttaacaccttgtgggtaatgaaacccttcctctcctccagatggcttgtcttttgcatatatcaacttgtagtcctagaaacgggttctctgggccatgcagaatgctggattatttttctgtcatctattatgacagacagactctgtcacttgatcagacataaacttttctttctttagctaagtaatgttcacattttaaagcaattcaagacccaagtccacagaaacagaagggccaacctactctacaaaggcacgttggaagagcatgattgatggaaacttgtaaggagtcaggcaaggtggctcacacctataatccaagccctttgagaagccaaggtgggtggcttggcctcgacctccgcaaaggcttggatttaaaaaagaaaacaaaccagaaaaaaaacaaacaaaaaacaaatcttgtaaggctacactttggaaagaaaatcaaaaacaaattcttcccacagatcacataactgcaaagggggaaacgtgcatttacaatggagagatcagataggtaccacttaaccaagtgcccaaactgggttatcaccaactagaacaaactaagattaccttctgagtattcttgccaaaaacttttaatttaaatcgaatcaagctcttagacttatcttctggtttacaaaaatacagtggattggccaggcgcagtggctcacacctgtaatcccagcactttgggaagccgaggcaggcggatcacaaggtcaggagttcgagaccagcctggccaacatggtgaaaccccatctctactaaaaatacaaaaattagctgggcgtggtggtggatgcctgtaatcccagctactcaggaggctgagacaggagaatcgcttgaacccaggaggcagagattgcagcaagccgagatcgtgccactgcaccccagcctgggtgacaaagagagactccaactcaaaaaaaaaacaaccagaaaactagggaacacatcaaagtgacactaggcaattccagaatgtaggacatgcaataatactggcctgaactctttctcaaagagttactacaatgagcagtggatggggtgagaaagctactaaagactaacagacataaccaaatgtaatatgttattttggggatgggggcagctacaaataacattctgagcaccactggatgaggactggatattagaaagtattatgatcacttctcggccttctggctaagatcaagtattgaaaagattatgaaagtactgttaattttcttagatgcaataatagtactttgattaaacaggagaatgtcattttttaaagagatgtgtgctgaagtatttaaaggttaactgcctggataattatcaacaatttaacgtggctcagtggagaaagcagagccacagttcaaacaaaaaaagcaaaatagtggtaactgttgactccagatggaagataatgcttttattgtgttattcttgcaacttttctgtaagtttgaattttttcataataaaaagttctgggggccaggcatggtggttcacgcctgtaatcccaccactttgggaggccgaggtgggcggatcacgaggtcaggagatttagaccatcctggctaacacagtgaaatcccatctctattaaaaatacaaaaaaaaaaaaaaaaaaaaaaaaattagccaggtgtggtggcaggtgcctgtagtcccagctactcgggaggctgaggcagagcttgcagtgagccgagactgtgtcactgcactccagcctgggcgacagagcaagactccatctcaaaaaaaaaaaaaaaaaagatgtgggaaaagtttggtttgggatgtatctagattgccaactaaacctaaatcaaagtatactaatattaaaaatcctgtaaatgggccaggaattgttacagagggaataaagaccctagcaatgttcacataagaagttaaagcactgcggggtttttctatgcccgtaaagtattctttagtctttggaatcaagaactgcatttagggtcgggtgtggtggctcatgcctgtaatcccaacactttggaattacaaaatcccaggaattagtaactttttttagtgagtctgcaaatgttactgaataagccagccgcaggactgctcatggaaggggaagggaggcacaggagaccgaggtgggaggatcacttgagcccagtagttacagagaccagaccagcctgggaaacatagcgagaccccatccctattaaaaaaaaaaaagaagaagaagaagaaaaagaattgcatttagtctttacctataacgtcctataatgtcataggtgaactaaaagaaatgataaatatatcctcctgttgtctctcaatggctttccaccactttcaaggtccaaattcctcatgcttagtatgactcagaaaagtccataaaacctggctcctgcctctggaatttcagttcttgccactcccaactctacccacaatggacagttctctggaacctgctaagatctcagacaatgctgctcctactggctaggtgcaaagacacaaaaactaagatttcaaaagcaaaaaatcccgggaaaaataatctatcacaacaaaagcatgagctcaggaagaaaagggagtggaggggataagagcaggggagggggaccaaacccaactttgcctcccttccccttccacgagcagcctggtggctggcttgttccgtgtgttcagtaacatttgcaaggaccaaaaaaatcactaattcctaagattgctgttactctcaaacaaaagtcaattcccaagcccacacaccccacagtcaagctgagagttaaaactcagaaaactcaaaggccttaggatactgaccctatgctggcaaccacatagctcagaaatgcaacaaatattaaattatggtgtcctgtaatggatttacactttacttttaaatattaacaagacggccacagggagtaagtttatcaagggataagaatcctaacagtacctcctagttcactcagaggccaattaacatttcccaccacgcccaacaacaaggctcctgggggtgttcaaagttgcttatgaccctgtggagctatcagcaggtacctctgccccagaacctattatgagcaatgcactaggggctcggtgcacaaggaaacacctgaactacaactacccaagcaaatatcatatctttgtaggttgtcgggtttcttcagctgtctgaagatacaaaacctcatgtgactgtttgatttttagtctcttctcaccttggtcttcctttctcacagttatttttaaaatcagcaactggctaatatttgaaaactgtcagtagccaactgtccgtttcacaattagatcactgttcaaaaggagcagaattttcaactctagactttagttcaacaagctagcaaatcattacaggaatgagtgacttcatctttacagctgggtcgctgcactatgaggctacactaaaatatacctaattgttgaattccaacatgtctgtaggccctccccgcatcttcaaggttagagtttttattattgcatcctcccccaacccaacccccccagacaaagcttggcattttcggaatccctactcataaagtgactcagtccaccgatgggccaactgacaaatccttaagggattaagatattaccaggtaaaaagtgacttttaaaaatgtacataatacatatatatgtagagagagagagtgtgtgtgtgtgtgttacaggaaagctattaactatactatgaataaaacaaaatttcactgaaaataaaagtgatcaggtagcactgactacaaccttctaaattccccctaaatgaatccacagaaagactttcttgaagggtcttttgctaatttgcggttagaacacaacacactcaagaaaatgatgctcacagcaggacactaatactaagtaatttctgagattatgtctgcatttgtgctaaataatttatgctaggagcagaaataaaagcagagatgaagttaagctattgattgaagactgtgctaaccccattaaaaataaagagaggtatgaatgtgtgccttcacaactcagctcaggatatacttgccaactgagctcttccttccgtaagaaggcccattgctcttggctactgcgcaggggctatgaaggccccatggttctaggactagagcagatgcgtacaaactccctaaagtcacaggaaggaaggggaggcacaactggagagaagttggtgaactgcctctctggcccataggggcatgagggcggggggcacagaataaaaccataaagcaataattttcactatttaaaagaacaagtctaaatggcacacatcctctgtgtctaagatgactagcactgctgttttttgatgagtcatcaagggcagtcatgctgaaaagcagggatacttctgtattccacctatgtaatcattccaaaattatgggattggaacattacaatacctatgatgtatgtccttatatttgtatgtgtttgtgtgcttacccttaagtggtgttttttgttttgttttgtttttgctgacttctttgttctagggggtatttctgcagccttctcagaaaaacctcagggtattagagaaggtacaacttgctaatggcatctggtgagcatgggctggaaggggaaccaccgggaaacacagttgtcaataaccacacccgctatggtgcaaacatgacccacatacaaactgaagtacaagtacaacccctcccaaaagtctagccctaagataatagcacagaaactaagcctaacaaggtgcttggaacctcttcctacctgcaccaaccaccctctgcacaccatccccagcaagaccccctgcctccaactcccctaaagcagcatttccaggatagcactattctttaatccactgacaactttggcactggctaaggcttactatttttatcccctttcacaccattctctgagcagaaatgctaggtgcaaacatttgttggtaattatgttaaagtaagtcttcttaagaacaaatggtaaaatgaatacatgaaaactttgcaatctatttttgaagaattgtctgcaaaaagagtggaaattgagtttttcttacgcagctgaaaggataaaacaaaaattacatataatcagaacacaatataaaataaggatcgtactcccccaaaattacatctgtatttggctgtgagaggtgaaatatctttgattgattgattgattgattgatttttgggatggagtctcactctaacgccctggctggagtgcaatggtgcaatctcggctcactgccatctccgcctcccaagttgaagcaattctcctgcctcagcctcctgagtagctgggattacaggcatgtgccaccatgcccagctaatttttgtattttttagtagagacaggagtttcaccatgttggtcaggctggtctcgaacccctgacctcaggtgatctgcccgcctcagcctccccaagtgctggaattataggcgtgagtcatcacgcccagcctgaaatatcttttaaatcttgttagcatgtgctctgaaagatatgttccaccttaggacaaacagcaaacaaactttatttcttcagaacacagcaaatggcagggtagagaatcaaatgacactggaagtggggccttgatctcacccctcctgatatggcaagcacacagggcctagagtcctgggctaaactaaaagatgaaggtcaacttggttactaatttcgcagagcaagtccaaggcaatcaaaatagaaaagcaaaaccaaccctggaactcacaaaggactggacacatgtcatggaattatttatagtctaggacaggtgaacaataatttggctggacaagaatgcaggcccttttctgagttcactctcactgttccaagaatgaagatgtcttgctattctagctgcaagacaggcaccagccatgagtccctacgtggtggtgtgcatgctgcctctgaaggacaagcctcataattatctggccaagatatcttgaaagaagcctactaatgcataaaatacataatcactgagccctggaagccatccaggtaccctcgggcctttgggagttggacagacatgtagcaaggacacattctctcaaacttcctcctaacacaagccttaatcaatattaagggttaaaaggtttcatttaacttcgataaagtaggtattagtactctcatagaaaaacaagctgagactcaatcactgctttcatttggcttaacagctcactactaggcttgctactaagaccttgaagatccttggcttccatatccacttcaatataaacattgttagtgctgttactggtaatgggggctggggggaatccccagggttcctggagcacaaagcaaagttccctccattctcctaattacattaatttaatcccttgcccactacatgattacattaaaaggggctgggggtggggagggtaacataaagccaagacccaaagttaaccacaatacaaaaggagagaagaatggatactatgatcttccttttaaactttcattatagctgactgcagaactgctgggatgactcaatagattatgggaaatggcctaaaagtctactggaaaccagactgaactgtggccacatcttaaaaataacctcttgcctctaattttcttctcccccaatttttttgactaaaaagggttttttgctgtttcgttgttgttgtttcgcaatcaccagtcctaaaatgaagctaaaaatttattttcattttatccttggtcattctctagcaccacaatcaagaacattaatgagtctttcctacaataccgaaagttagttaaacaaataccttgtttcccagcactttgggaggccgagacaggcggatcatgaggtcagaagttcgagaccagcctggctaacagggtgaaaccccgtctctactaaaaaaaaaaaaatacaaaaaattagccaggcgtggtggcatgcacctgtagtcccagctactcaggaggctgaggcaggagaatcacttgaacccaggaggcggaggttgcagtgagccgagatcccaccactgcactccaacctgggcaacaaagtgagactacatcttcaaaaaaaacaaaaacaaaaaacaaaaaccttgtttcacacatcagctgaactttcagtggacctgactactgaaccccaaaggacagccaggttttcctttaacacatattgctgccataaaaactgctgttatcaggcaaagaatgaataggttatttaggaaatatggcaaatatttaataactgatttttttcagtatacctgccttgaagcaacagggaaatattacaggacttggcccctaagctcagcaatttgtcaaatgagtaagtggtaaaatcacgctctccaagatacctctcactaaatacatttatcacattccagaagaagaaaactattttgacttgattgctacctttaaactgtccctttttcaggttttctatctatttcaaatgagacaagcttatcctttgattaaaatgccatataataaaatccatcaaatcatattagccagagggtcaacaatccagctattcaatagcattatcattattttactagtagcacaaataagagggctgcatgggctgaagagccatttcaacaagctcttggagtgttctggacacagagaccatgagtgttttggaacataaggctgagctatggagacccttctgcagcaaagaattcctgtcagaaataagactcgatattagaggttgttttaaaaaataataataataaaagcactgatgtgcatcctaggatgtttagcaaaattaaaacttaaaaaatttaaacttaaaaagcagtgaaacatgctgtaacatagatgaaccttgaaaacatgctaagtgaactatgccagaacacaaaagtacaaatattatatgattccatttatctgaggtacccagaataggtaaattcacagacacggaaagtagaatggtgattattagaagttgcggagaaggggactaataataggtggactaataatagaggttgagaaggggactaatttttaataggtgcagagtttctgtttggaatgaagaaatcaagttctggaaacgaatagtagtaatggttgcgtaatattgagaatgtacttaacgccactaaattgtatacttcaaatgatttaaatggtacttttttttttccgtaaagtgaaagcaagtttattaagaaagtaaagaaataaaagaatggctactccataggcaggacaacctaaaatggcctattttatgttatgtatattttaccatatattttaccacaatttaaaaaaactgtacataaaaactagaattataatttaataagttccagcactttggggaggctgacgtgggagaactacctgaggccaggagtttgagaccagcctgggaaacagagttaaaccttatttctaccaaaaacaattagccaggcgtggtggcatgcatctgttgtcccagctactcaggaggctgaggctggaggtttgtttgagcccatgtgttttaggttatagtgagctatgatcacaccactggactccagcctgcgcaacagagcaagaccccatctctaaaaaaaaaaaaaaaaaaaaaaatagtaagaagaacataggtggtaaataataaacttagccggaaggacactgaggttctgtatttaaaattcacgttaagagtcagagcgctacatgcatccgtaatcagaatcaaagaatccacactcccaaagtgacaaaacagccccaaactaatttctctcattttaatgctgcagatccccaaggcccagaccctggacttctcgatctacactcactcccttggtgatctcatccagtctcatgatttcaaataccacctgtttgctggacactcccaaatccttatattgagccctgacttctgcactgagcaccaggattgtagaccaacagcctccctgccatctccactcagaagcctaacagttacctcaaatttgtccaaaaccagatcactgtccttcccgtccacaaacctgttctaccgcagtcttcccatcctggttaatggtaactctacccttttaccctcattccttgtcagttcattctcaattaggcaaccagtggcattccttacaacagcagtcaaattttctaattcctctatttgaaaacctccaagaaaggctgggcgtggtggctcacgcctgtaatcccagcactttggaaggctgaggtgggtgaagggcttgagctcaagagtttaagaccagtttgggcaacctggcaagaccccgtctctacaaaaaatacaaaaattagtccggcatggtggcttgcgcctgtagtcccaggtccttgggaggctaaagtgggaggagcatttgagcctttgaggttgaggttgtagtgagcttccattgcatcactgcactccagcctggacaaaggagccagaccctgtctcaaaaataaataaataaataaaaaccctccaatgaattctcatctcattcagagtacacatcaaactctggacaatggcttacactaaaccaggagtcagaagctgtggtgggtgaatcctgcccagtgcctgccagtgtgaataaagcactgctggacaccctgtgcccctctgtgcactgcctactactgcttcggcattgcaggcagagttgagttgttgctatggactgcagagtcgaaaacgtttacatctggcccttcgcagagcaagtctgtctacaccagctcttaaatgatttcccttatccctctgacctcatctctctagttctgcacctcactcactctgttccagccacacgggccttctcgctgtcctgtcctgaagatacccatgcaagctctcaccacaggccactgacccaaccactgtcttggcagcgctgcccagacaaccacatggcttgctcgcacacctcctgaatacctcacttcagtgagaccttccctcatcacaatatatttaaaattgcaaaatttcctctctctactccctgcaaagcatccactttcctctgcttctccaaagcactaattacctaaaaggacacacaagtttgcctaccacatagcagcagcccaataaatatttgttaaatgtagttaagagtattattagtgagcctaaggcaaaaattcaagattccaattctaggccggcgcagtggctcacatctgcaatcctaacacttcaggaggttaaggcaggaggatcacttgagcccaggagtttaagatcagcctgggcaacataggaaggccccttctctactgacataaaaaaatattagcccggcatggtggtgtgcacctgtagtcccagccagttgggaggctgaggtgggaagtctgcttgagcccaggagttcaaggctgcagtgaactgtgattgcaccactgcactccagcctggttaacagagtgggagaccctgtttctggggaggaaaaaaaaaaagtgacatagaaggacgacatatgcttatatacaacaaatacaaattctcaactaaaagttaaataataaaagttatcctagaaataaactgttttgatttcacaaataatgttctccttagaagttgcaaactatctgcacataaatgtgctctgtttagtctaacaggtattttctggttttccttttatctttaagctgaataaattgtcaggtaaatggtttaatggttgaaagtattaactctggaggagggctagacaggtttaaatttttttttttttttttttttttttggagatggagtctcactctgttgcccaggctggagtgcaatggtgcaatctcggctcactacaacctccgcctcctgggttcaagcgattctcatgtctcagcctcctgagtagctgagattacaggcacccaccatcatgcccggctaatttttgtatttttgtagagatgtcggttcaccatgttggccagcgtggtcttgaactcctgacctcagatgatctgccaacctcagatgatttgcccacctcggcctcccgaatgctgggattacaggcatgagccactgcgcccggcctagacaggtttaaattctagtcagctgaatgacctttggcaaattattcattctgtgtttcctcatccataaaacggggataataatatccctatctcatttgtattgaatgagttaatattggtaaaacatttaagaataaagactgcagccaggcacggtggctcacgcctgtaatcccagcactttgggaggccgaggtgggtggatcacttgaggtcagaagtttgagaccagcctggccaacatagtaaaaccctgtctctactaaaaatacaaaaattagccaggtgtggtggcacatgcttgtaatctcagctacttggaaggctgaggagggaggatcgcttgaacccaggaggtggaggctgcagtgagctgagatcacaccgctgctttccagcctgggcaacagagcaagattccatctcaaaaaaaaaagagcaaagtaatagtacctacctcactgggtcaggaagagaagcaacacatgcagagctctaagggagtcttgtatatggtgagcgctaatgtgttcattcagaatttactttaatttaaaaaaaaagttggctgggcgcggtggctcatgcctctaatcccagcactttgggaggctgaggcaggcggatcacaaggtcaggagatcgagaccatcctggctaacacagtgaaacccggtctctactaaagacacaaaaaaattagctgagcgtggcagtgtgcgcctgtagtcccagctgctggggaggctgagacagcagaatggtgtgaacccaggaggcagagcttgcagtgagccaaggttgcgccactgcactccagcctgggcgatagagcaagactcctcaagaagaaaaaaaagttggtccctgaactgaaagaggccacatatcaaggacataagcacgcaaaatcagcaagtgccatacagtaagtactgatctacaacagaaagaaatcaaggcatacctgcagacttaaacgacatactgaagagccacgtccttgttcaaataattccattccaattccccagagaacagaggtggcatgcggtaggattagagtttcactcagctaagacagaggtttgagtccctgctcggcttagctgtgtgatcttgagctcgtgaccaaacttcttacagtcttaggagagttagaaataacaaatgtagattccagagtgattgaaacagagtaggccttcaggaagtcacagttattatttgtataagcctttcagtttagagtaattttagaattatagaaaagttgtgaatatagtacacagagtttccatgctgttattttattttcaacaatattgttattctgattgtgaagagaggtaaacaatttctaaattacaccttaaaaatccatgacaacaaagaatactgtcactctaggaaacttctgatttatgcacttaaacacaccactccgcatcaggtgaactgatttcccaagtttgttaagatgtgttacacagtttaaaggcagacatgactaagaggctaacatgtgtatcacagacctaggaacactttctccatgttgccgtctctaaaaggaacttcagcaggtgcagtgggtgcctcctctcaactcataccacaaacccaggggcttcaaaaattactttccctctaccagggcccttcaaaacacagtatttcctaaccaacagaaaacgaaaaactctgtgacccagacagcccagcctttgaaagcagcaggggtagcaactgctgagcctcaaaagtcagcctctgagtagccacccagaatgcaatgggctggcaaacagtaggggagaaaaacgctggatccaagcctggatcccagtgctcaccggacaatcatttgtcccatttcctcaattatctgtttgtctcctatagctgtctatcataaaggcaatgtgaaaatattattttaaattttacagaatagaaattacggactcagaagaggcatatccagacaataggtagaaaagtagaaaaataacagctattgtcctagaaatcaaatacaatacacactaacatttagatctgcttttaagagctttcaaaaacctcacgttattagacatttttggatagttttaaaagtcttgttctttaacagtaagaaaaatgcatcccctgaattgaagctttagagtatttaaagtgaaaagcttgctaagagataaatgtgcaaaaaaaaaaaaaaagtagtatttgagcattgcagagggatttctcctttctcctgagctgctgctgtaacatctcctctgactcagcacctaagaggcatgatgggaagggagtactataaaaaagccatgcattattaacaagacatttggcatcaaagcagaatgatttggaaaaccggaaaatgtccgcagaataagagaaaggggagctaacagcttaaattatttttggtagtgtcatgccattcaaaattgtccattctaatcttctaagctgtctttttctcccttagttttagctctaattctgatctctttatgtctttcctaccttacattccaaatggttactacttacattctgagtggatttctctgtgttggtttgctcctgtcagttttaaagaactgctgtacacgcattagatccaatgaagacagactgcaacagaactgctctgcagaagcccaagagataccacacataggatgttaacacttactactgcctagaaatcaagagtctgtcttcttaaccctagaataagcaaccaagtgacctaagttcccaattcacagatggcaagccaatggttaaaaaaaaaatacatttactcttacaaccatttttaggaccctagaatttaccatcaaattgtcagtaaaaaatgaagctgggccaggtggagtggctcatgcctgtaacctcagcactttgggagaccgaggcaagaggacctcttgaggccaagggttcttgctatgttgcataggcaacatagcaagaccttgtctctgcccaaaaaaaaaaaaaaaaaaaaaaaagccaagtgtggtggtgcacacctacagccccagagacccacaaggctgaggtggaaggatcccttcagcccagaagttcgaggctgcaatgagctataattatgcctctatactccagcctgggtgacacagcgagaccccatctttaccaaagaaaaaaaaaagaatgaagctggcatatagtccaatggtcagagacaatgacttgagtaactcaaaatccaattctgcttttctggcattatatcaaattaggaaaactattcccttcctttaggccagtagttctcaattaggggtgcttttgcttcccaggggacatttggcagtatctgggggcatttttcgttgtcaccactgcgggagaaaggtgctactggcatctcttgggtaaaggccacagaggctgcaaaacatcctacaaggcacaggacagcctcaacaacaaagcagcatgtcaacagtgccaaggttgagaaactctgccttagacaaatcacttaacttctactgacttttaaattaaccactgacactgttagaaagtacagcagtaatgcataaacgttaagtttatatttgctggttcacatttattggattaataaacatgctgggcgcggtggctcatgcctgtaatcccagcactttgagaggctgaggtgggcggatcataaggtcagtagttcgagaccagcctggccaacatggtgaaaccctgtctctactaaaaatacaaaaattagccgggtgtggtggcaggcgcgtgtaatcccagctactcgggaggctgaggcaggagaattgcttgaactcgggaggcggaggttgcagtgagccaagattgcaccactgcactccagcctgggtaacagagcaagactctgtcctgggaaaaaataaaaaataaaataaaataaacagataatttattttcgattccctataaactgaatatttcttccttagtaaatggagcacagactagcatcaccttttctgcaacataagtaacaatgcacatgtgcaagatttgcataaagtagcctctgcttctggctatgactgagagcctgtggcagaccagagatccctcagagaaacaactccaacagccagagaaaattaaaaaaaaaaaaattttttttttcaaagtctgaagactttggagaactgtggaagctactatgacttgaagagacacaatccggaagggtaaaccctttaggagcaagccaatatgccacaactgctttgcccctcagggaatctgccaatgctaggtgccaggaaggaggctgaggaaacagaaaagcagcctgggaacatgaccagagccactattcacaggcagagaaaccagcagagctcatggtaatgtctcaggcctgaagaaagaaaaatagagacaagggcctaggattcctgtgaaaagaactgagtgttttaccctgaagacattttacaaaatcccaaagatgcacaggtcagaaggctgaaaccaagcagaaagcctctgaatagcacagcaggtttcttcaccaatcccatgtactaagaagacaaagattaaagttcaggacacaccgtgggggacaaagattaaagttcaggacacaccatgggggaagggccccagttcttagccagaactcctgcagggtacttccaaagagtagaggcaaaccaaaaagagatggagcctgaccaaaaccacgcccttgctgtggtcagctcagacaagataaatggaatcagcccccattctatttgcctagcaaatggtgtaagccatctagatattagaaaatcatctagggtcgctacaatttttttatatacaatgcccacttttcaataaaaattaacaggcatgccaaaagataggacaaaatgagtgtcaaggccgggtgcagtggctcacgcctgtaatcccaacactttgggaggccaagccaggcagatcacctaaggtcaggagttcgagaccagcctgaccaacgtggagaaaccccatctctactaaaattacaaaattgccaggcttggtggcgcgtgcctgtaatcccagctactcaggaggctgaggcaggagaattgcttaagtccgggaggcagaggtggcagtgagccgagatcgtgccattccacttcagcctgggtaacaagagtgaaactccatctcaaaaaaaaaaaaaaaaaacagggtgtaatattttaatattgggtaagacagagcaaaaaaagagaatgattgatccaaaagctatgccatcagaaaacatctagactgaaagctggaggagaaggaaggagaatagaaaaatacagatttgtattgagtgctagcctgagaaaatgtctcagcaaaacagtgtttaggtatccattggatgatacatgcagaaataaacacagatgtcacctctttgacaattatacaggatttatgttacttgatttccaagtaacaaagacagcaaaataatcagaaaaaaaatatttagactcaatgagaaagataagagagatccttaacatactgaggatgaagaacctgataattcttagctcactctcttatcaatctcaaagttaaaatgatcacgggagtggtgtgattcaatggatccgtttctgccccgtgggaactacaatttcacagatacaaatttgtaacatcttttttgatatctaatcaccgatgtgaaaatttttaacatttttaaaccgttttattatgaaaaatttcaaatatacagcaaagttgaaaggattttacagtgaactcccatatactcaccatcttgattccactattaacttgcttatcacaaatatatccattaatccatcttactttgtgacctatttccaagtaaactgcggagatcagtatacttcctgctaaacacttcaacatgcatgttaattaattagattttttttcccttcttggtgtaaaagttcatgcaatgaataggtgtgcatttgcggagtttgacaaatgcacatacctgtgtaatctaaatccctatcaagatatgaaacattacaatcactcctgaaaggtttcccaagcccctttccagtcaatccctacccttatttccctctctcagaataaatgtttttttgtttgtttggagacggggtctcgctacgttgcccaggctgtcctggaactcctggcctcaggttctgaggagctaggtctctaggcatacatagcacaagtgtttttgttgttgttatttgtttgtttgtttttgagacagtctccctctgtcacccaggctggagtgcagtggcatgatctcagctttctgcaacctctgcctcctggcctcaagcaattctcctgcctcaatctcccaagtagctgggattagaagcacacaccactacacctggctacttcttttgtatttttagtagagacagggtttcgccatgttggtcaggctggtctcgaactcctgacctcaagtgatctacctacttccgcctcccaaagtgcggggattacaggcatgagccatcatgcctggccacaagtgttatttttaacccacggcactttgaacaatcttcaagtctctggtgtgaagagacagtcttagaaaagtaatgtttaaaagggataaatagccaggcatggtggtgcatgcctgtaatcccagctactcgggaggctgaggcaggagaatcacttgaatctgggaggcggaggttgcagtaagccgagattgaaccattgcactccagcctgggcaacaacagtgaaactctaactcaaaaaaaaaaaggggggggtgacaattatattttaattataaaatagtaaatgaaaccatattcctgaagctaaatttaatacttacaaaaagttgcaaaaaagttatatctgttacatctttaaatgcatataagccatttaaatggtatcaatctaacagctaattttcaatgaaatgtttagtctcaaagaaggcataccgattgatatgttcaacacaagtattcttgtttcctaaaattctatttttatgaattcatggagacacaaaatatcctagagaagaatccttaccctgaaattgcaatttatctataatttatattccttgaatacctgggtttcccttctgcatataaccaaatggaatcctttcttggcaagaatggattgctgcctctactgtgaactgtagttacctggctctaactggcagacagataatttaacgtaaattagcagattatgcctgtgctctggtcctagaatattatttaagagatagcagataagagtggtaaatgatcaaccgggtgtttgctgaaacttcctggagggttaagtaatttattattaatttttgagactagctatagatgggaaaaatgagtcattctgattaaaatgacggtgcggggcaatcagccagctttagacactgctcctatatcaagtacatgccaggccaggagcaggggctcacgcctgtaatcccaacactttgggaggcagaggtggaaggactgcttgagcccaggagtttgagaccagcctgggcaacatagtgaggccctgtctctacaaaaaaaattttaaattagccaggcgtgatggtactacgtaactgtagtcccagctactcaggaggttaaggtgggaggatcgcttgatcctgggaggttcaaggctgcagtgagccatgattgccacactgcactccagcctgagtgacagagtctcacaaaacaaacaaaaaaaaacccacacgccaaaacatgttcttctgcagtatatggtagagtccacattttcttacaggactgaaaacctgacagtcactttgcctctagactacagttttaacatttttagttagtatataaatctgtacatataatgtaagctcaattacgtttttgaaaaattacacatactcccctaaaaaaagatccagaagaaaaagcaccaaaatgttaacagtgtgttatctttgggttatgaggttttagattgtctttattttccttatgcttcgctgtatttcccaaattttatacactgaatgtattatttttaaaatccaaaataaagataccggggaaaaaacaaaaccctaggcagtgactgacctgtaatgatcaccaaatgactgattttatcacactgtgattatgaagctacaatgaatgaatgccctttgtcctgatttatccttgctgccacccaaaggtacatataacctgattctcctggcaacaacacaccttggcatcccacttaccccatgtctgtaaagaggcctcagacagtaattcaaccatttaaaaactatgtcccctacaattatgctttctcactatcttcagagtattctcacctactgttttttttttaatgtattcactgtagtgtgccttataaaaacaataggtatgttgagtgtgctgtttctatttatacataagcctttcactcccatccaaaagaaaacatcccagcctgggcaacaaagtgagagcctgtctctacaaaagaaaaaaaaaaaagtagccaggcatggtggcgcgtgcctgtagtcccaactactcaggaggctgaggcaggaggatcacctgagcccaggaagtcaaggctgcagtgagctatgatcgcatcactgcattccagcctgggtgacagagcgagaccctgtctcaaaaaacaaaacaaaacaaaaacaatagaaaatatcttggtatcaccatatcatcatccaatgccaactttatgaaaattcctgatgtaaactggtgaaaatccttggaataacaactagaatgggactcagttgtagtgctggcattgcctaggaggctgagtatatcctttaaacctttccatgattctgttttcccacctgtaagatacaggggtaagcccaataattttgagtatcctttccactgaaaacctgtcacactgcctctagactacatttaacgtttttagttagtatataaaactgtacatataatgtaagttcaattatgtttttgaaaaattacacacaccaaaaaaaattatccaaaatgttgcgattcttcagatcctgttgtatcttacacagtcatgtgccgcataatgacgtttcagtcaacgactagctgcatatccaatggtgatcctctaagattataatactgtatttttactataccttttctgtttagatatatttagctacacatttacttacctacagtattcagtacagtaccatgctgtagagatttgtagcctacgaataataggctataccatacagccaaggggtgtaataggctataccatctaggttggtgtaagtacactccatgatgttgccacaatgacaaaatagcttaacaacgcatttctcaggatgtatccccatacttatgcaacatatgactgtgtttgtgaattcatcctgaaaacacatctgagattataatctcccaatagtcagaatatcaatcacggtagcaataacactgactgcatatgcttgccaccacagggactttgctaagttcttcactatcaggtagaaactaatatcaattccaatgaagaaactgaagttcgaacagaatggtccagtaactggcccaaagtcaccaaaccagtaagttgcagagcggggacaagagctaagaatcattaggctccacagctcattgcagtttctctctccaaggtgcaggctaattctccttgtcctaaacaacacaacacagtatctctaccttgctgtttctaaaggccctaaggtagatgactaatagggaagctctctacatctgatttctaggagtctaggaattctgagtataaacgtcttcactattcatggttacatatcatcaagaaacaagcttactttcgccaccactttttaagacattttccaaaagcctgctggcagcagtgtgcgcttatgctcaggtgactagctaggccccagaagtttagagaacagtgcaaatgaggttaaggtgccaggtggactccagggcaggtatgcagctttgcataaagaacaactctttgcataaggggtagcctcaggggaggttccccaatcccagaaagtgaccttacaaatgcctacccacaaacagttaatgaagggaacaaaggcacaacaaaattaatctctgcacctggaagataactcaaagtgacaggatggacacctcactttcgataattagccacctcattagatttacaaaaaaataacagaagtgagatgacctgatcaactaagctagcagaagtctaagccactcttccttgaaaagcagacagcttatgtaaacgtactttttattaacaccctaattttcacatttatttccagaaagaagttagaaaaagtatgttcctcatacttcaaagtgccctttctgtatagagaggcgatgtgcctagatgggaaaagaatgggtttacctaggcttcacacctacctaccaccgatttgcgcatctatttttcttttcccaactataacttttgaaagttatagttgggaaaactgtaacttcctcttcctaaatcaaaggcaaatcaaagtctgggcacggtggctcacacatgtaaccccagcactctgggagggcgaggtgggaaggtcacttgagcccaggaatttgagaccagcctaagcaacacagggagacctagtccctacaaaaaaattttttaaaaagtagctactggtcctagctacttgggagggtgaggtgggaggatcacttgggcccaggaggtaaaggctgcaatgaggtgtgatcacaccactgcactccagccttggtgacacagcaaggccctgctgagaagggaaagggaaagggaaaaggaaagggaaagggaaagggaaagggaaagggaaagggaaagggaaggcaagtttgctctaacacaactgataacacctgggaacaatatgcgcataacctgaactctgcctttgcatatgcacaatttcatccacgaggaaaacccagaaaactacacccagctggaaagacagacagatacacacacacacacacacacccctgaagcatctaccagctactcagttcaccaagtgggtgccacacacatctgatgttagaactctcaatgccatttcagagaaccctccttctaccacttcacaataactcaagctgcaaccctgctgatgctcacttctatgagcaaaccacagatttagattttcaaagtgccatatttacagtattccttaactgcttaacatgtgaacacctgcactgttttcattaggttctttttttttttttttggtgatgagtaactaatgcagtttttgcacacctaactccaatttttcataatctctatggcttttattgaacaatctggcatagtgcagtaattttttttttttttagacagacttttgctcatgttgcccaggctggagtggcacaacacacaaccccctacacaatccccagcccctttcagaatgtcttccacggaactggtccctggtgccaaaaaggttggagaccactgctttatatggattaactcattaaccacagggtgaagtgaacctatcatgacagtctgttgtggtttatttttttttttttttgaggtggagtcttgctctgtcgccaagctggagcgcaatggcgcaatctcggctcactgtaacctccacctcccgggttcaagcgattctcctgcctcagcctcccgagtagctgggattacaagcatatgccaccatgcccggctaattttgtatttttagtagagatggggtttcaccacattggccaggctggtcttgaactcccgacctcaggtgtttggcctcccaaagtgctaggattacaggtgtgagccaccgggcccggccagtgtggtcactgttagaaatgcttatgccatgttatagcagaactatttaatataatcacctttgtagaaaagaataaactgcatgacattaatgatattcccattctgtacatacagatacctttctaaagggtgggggtgggaaaagaaaacaacacattgagtttcaatctaatcatttccaacaactcagaagcaaagaaatatgctgagttttcattatgtctaatgcttccatgtgggatcttccaaagggctaagaaagcctggctcagcctagagaatgccacacaaattaactacagatttaactcctttaccgatgcaaaaggcacgctgtgtcacacagctgtgtatgaagaaacaatggaaataatcgcagtaaatgtatatagttaatgtgaccagggtagcccaactctttggtcctgctcaattgatttgacctatgtcataacagactctcaatcattcaaagtttactcactcttgacaaactagagaaaaaataacaatctagagaaaaataattactaagtccaaacaggtttctgagaagagctttattctactttgtggaatccaatcaaagaaagaaaaaaactaattagacatactgttgtaacatttaatgagatttgaaattcatctatttaaatttattaatagtaaaggaatgagattaaatagacttgacatcgaaggggctagaatttcccatgaagttttccacattatcggtaaagacagcaggtatgttttctttacagctttcaagaatcccttgccagaaataatcttatattaagacaggatgtttcgttatagtggggaaaacagaactggccaggaaaagatcttatagcaaagagattgtaaaagattattctagcacaaatacagatttaaattgctgccatcctttttctcccagcccagcaattcctgaggtgcaaaattttcaaatatctgtgtatacaatgacaaggacacaagtgaaaacacttgtgatgaaagggttatgaataaattactgcaatttccttttatcaaccaagttgatttaatggtttaaaaatattgttcaacagaacaaaggtggtaacatttgttagatcctaattaaacgtgattcattctggaatgtttctgatgacacagcttacataaataatctactgggaagtctactcaaaattcacaatgaagagtcggtttttcacacatataatacaacctgaaactatagcttcaatctatgcagatggttttactattttaattatacaactaattaataccaaaattagatcgatgttgtttaatttgtggctactgaggaatgttactattcacaaatcacaaaatctgtgccaaaataagtcttcaaagggatattgttgcctccttacccttctaagctttgcagtgggctttggtcaaagctgacataaacagctaaagaaattaacaacagagtctcagaagacaaggccaggggagccaaaaggacacaggtgctacacacccaggcagttgttgtctgctcccagagcacctgacttcagcagccacagcacctgctcctcaagcgcagcggcgcctttgagggagcacagcctggaaggtttacccttcgcagagacgcttgctcttggacttctggctgtacattctgagggttcaaatgaaggatgggacaatgggaaagcttaaatcctctggaaacgtcactgtgatcaatggcttcaaccctcctctacctcataccagttcactggagctgctaacactaagtttccttctttatccgcccatctctattccagtggagccccgtgattaagggatggcagaggaaggggacatgtccttttttttttttttttaacagaaaaacactcatttagatacctggtttagtaagacatctgaacaacatgaaacccaactatgtaaaagctttaaaaatccaggttatgaattagcctaaacctgtgcttatgttccattctgtttagaggaagggggatggaatccctttcacctttatatttttcatgacaagtccatggtcacatcaaaaattacttttgtctttaacacagttgaaattattaaatgttatctagacctaaccaaatcctatttccttaatgttatattcaggacagtgaaaaaaatactgttttcttttagcaaagtctgacttttaaggctcagtttttacctgattaaataaactgcccctgcttttgaggttagaaaaattacttttgttcatggggtccattatactgtactattaagtttacttttatatgtttggaaatttccagccgggcgcggtggctcatgcctataatcccagctactcgagaggcagaggcaggcagattacctgaagtcaggagttcaagaccagcctggccaacatggcgaaaccccatctctagtaaaaactacaaaaattagccgggcatggtggcacgcacctgtaatcccagatactcgggaggctgaggtgggagaattgcttgaacctggaaagtggaggttgcagtgagccgagacggtggcaccacactccggcctgggggacagagcaaaactccatctcaaaaaaataaaaaaagaaaaaagaaaatttccataataaaatgaaactcttaaggaaaaaactgctttgaacataaagccaacccaaaaagtagctcttacctaaagtgaattttccctagtgccaaatgaaattcaaataaatcccaatcttctaattcacacaaatcttaagatttctaatactttaaaccagaatgaaaaagtcaggtatgccaaattaacaatcgaagagaaaattaatcccacaccaaagccaaaacattgaacttcctcccactctcgcattcacacacacacacaagcatgaaccacacaatgaaggattccagttgccccatccagacaactggacgcacatcacacacctcctagtcatccagggaccatcttggcagcctgtttctcatcactacctgccaccctgtgcctgtgttgtggacgaggaaggcacgggtagtagcctagctttttatttttttaaatctcagcaatagaggcaaggttatttctaccttacatccaagagtatggagcacaagactagctgtttattaataacatgcttattttccacaccaaccacacggttttccaatttcacaaagtaaatacttcctcatccctctttagaaaagatgaaacaatttatcgtagcctaagcaaaaaccacctatcaaagcaaagactggcaagcagattcaagacataaaggtatagcttttactataaatttgaaaccaacaagaaagccattaacctaaatatttttctaatcaaaaatcagaaatgacgttaatagcaacatataagaattactgtatctaccacacttagaatgtactggggtagatgacaatgacaatcagtactgattgccttatgtttatcaactttttcatctacatttcaggtttcagtgcaagacaaaccattaatacattcatgactagccatttcaaagcattattgtatacatactgtacgacacaaagtgcttaattgtaacttaaaaggttaaaacccatcttgaatcctaaatgggcaaaaaaaaaaaaaaaaaaaaaaccccactagtcatttgcccacaaaccaggccccatataaccatcaagcatctgactgcatcggacatgattaatctgaaactgtgctatgaatcatacagcagtcctcccttatcttcaagggatacgttctgaaattccccagtgggtgcctgaaactgcaggtagtaccagatctaaatacattgctttttcctatacacacatacctatggtaaagtttaaattataaattaggcacagtaaaagatgaataacaatgtaaaaggaaaataaacttggggaccccaaacccactaagtcaaagagaaaagtcaaggtaggaacggcatcatgcaaacctacctccctcacaatctgcccaataggaaattccttgtggacctcaacatccttaccctacaaccactctgctgaatttcaccctgacaacgtaaattgacagcttatcttcacaggtataggacaaaggacagaacttaaagtcattcctctgcttacctgagacaaatgcataatctcatcacttcctctgcccggtaagtatattttgtcttatgtaaaaatgcagattcactgagctagatgaatgcataagggactattcctccgctgccccccacccttgcccgccacatgtgaatagctgatcaaagactcaaaagaatgtaaccatttgcctcctatctaccacgccttcctaaaatttctccccctttaaatactgaagccctcaaaatcatcttaggagaaaggcacagaccttgggcctgggtgcatgcccttaaccttggtaaaataaacttctaaataaattgagacctgtctcagatactttttggtttgcaacaaatataaaatggttttacaatttggtttacaacaacaacaacaacaataaaatggaacaattataacaataataaaagtaattaagtaaagttaatttttctgagagagtctcactctgttgcccaggctggagtgatcatggctcactgctgcctcaaactcccaggctcatgcgatcccaagtagctggggctacaggcatgtgccaccacacctggctaatttttatttgtatttttgtagaaacaagttttcccccaggttgcctaggctggtctcaaactcctgggcttaagcgatcctccagcctcggcctcccaaaatgctgggattacaggcatgagccaccacacctggccataagattaaaattcaaaagtattacaaataataaaattaaaataagggtcacttgaacacaagcactgtgacaccacgatgatgatgtgataatccagacgactactaaatgtgtatacagcgtgggtatgctggacaaaggaatgactcacatcccaggcaagacaaagggggacagagcaggatggtgaaagatttcatcacgccactcagaatggtgcacaatttaaaatttgtgaaatgtttatttctggaattttccatttaatattttcagaactcagtgaaaccacagaaagtgaaactctggataagggggtgactaccttattcactatcattcctggcaattaaagaatgttaactccaactgaacaccagatgaattggccctcaattaaacacatctgtccagaaatataaaatcacccaaaactaaaaatttactaaagtgaagcatgctccttagaagacttaaaaaataacagtgatacactgtctgctttgttcatcactgtatccttcaagtctagcacactgtaggggtgttacacagagattaatgaatttagctataagaaaatagcaaaatcaggcaaatgcaaagatgagtttgtaattttttctcttttatcacaggcaccagaacataaaagttttctaagtacccacccctgcctttaatcaccatttttatcactcacatttagataaatacatttgcagttcagctgatatcagaaaaaaaaatatgtatcaaattgtcaaattttactaagtcagagctgtgggagtccagcagcttttacacgttagatttttctatttcctcattcgtcagcatttgacatcattttctgatgttataaaggataacagaaaaaaaaaccctgtgcacacatcacgcccctcctagtcatctagggaccatcttggcagcctgtttctcttcaccacctgccaccctgtgcctgtgttgtggacgaggaaggcacggggaaacagaatattctggtgaataaagcattactaattttcaaagaattagaaggcaaaaacaaacaaaaaaaacacccacaataccaaactgaaagtcatgcctcagggtctttattgtaactacttaatactaaacaccaaaacataaatgatgctgattaatggagatttggggctaagaaaataccaaacaggctaggcgtggtggctcatgcctgtaatcccagcactttgggaagccaagacaggtggatcaggtgttcaagaccagcctgaccaaaatggtgaaaccccatctctaccaaaaataaaaaaattagctgggggtggtggcatgcgcctgtaaccccagctactcaggaggcggagacaggagaatcacttgaacctaggaggcagaggttgcagtgagttgagatcatgccattgcactacagcctgggtgacagtaagattccacctcaaaaaacaacaacaaaaaaaggaaataccaaacaaaatgtgcttttccctatcttcgaaatcatcatgtcttttcattcctgtatggcaaaaaataaatcccgtgtcgcctgccgaatccgaatctaaataaatgaataaagacagagaataataaagaaagaaaacagcttcaaacttaaacacgttagagcaagagaaacaaacaaacaaaaaaaaccatgactcctgctttctcaaaaatcacatcagtagcttataaagaccttcatgggcagaaaaagaatgggcacactgtagggagcaaaaggtaagtgataatatttacaaagtagtgtattttaaaagcataaacaaaaaattaggtaaattgggcctcattaaaaacttttttgtgcatcaaaggacactatcagaagtgaaaagacaacccacagaatagaaaatatttgtaaatcatgtatctgataaaggtttaatattattcagaatccgtaaagaactcctaacaggccgggcatggtggctcatgcctgtaatcccagcactctgggaggcgggggtgggaggatggcttcagtccacgagtttgagaccggcctgggcaacatagggcaatcccatctctacaaataatgtaaaaatcagccgggcttgctggcacgcactggtggtctcagctgcttgggaggctgaggtgagagaactacttgagcctgagaggttgaggctgcagtgagccgtgatagtgccactgcactccagcatgggcaacagagcgagagtccatctcaaaaaacaaaaaaaaaccctaaaaaatagtgattactggccaggcgcggtggctcacgcctgtaatgtcagcactttgggaggctgaggcgggcggatcatgaggtcaggagatcaagaccatcctggctgacacgatgaaaccccgtctctactaaaaatacaaaaaaattagccgggcgtggtggtgggtgcctgtagtcccagctactcgacagtctgaggcaggagaatggcacgaacccgggaggcggagcttgcagtgagaccagatggcgccactgcactccagcctgggcgagactccgtctcaaaaaaaaaaaaaaaaaaaagtgattactgcataacattatgaatgtaatttatgccactaaactgtacacttaattacttaaattactaaaatagatacatggcaaatttcatattttaccaccaaaagaagaaaaatgtacaaagtagatttggaaaaaattaattcagtcacttcaaaatcaggattaattaattcctttccccaaagtaaatgcagtccaacgaccaagaggctggtctgcccagacaatagtttcttctttcatttcattaaatatttaagtacatacaacgtgctgggcaccatcctaggcacaaggaaattacaatccagaaaacttccctctcatgactatatagattatgaggatatgggtcaaatgagcttttctaaaaaagttaaagcattaaatgcttttatttaaaacatacagattcagccgggcatggtggctcaagcctgtaatcccagcactttaggagcccaaggcaggtggatcacctgaggtcaggagttcgagaccagcctggctaacacggcaaagccgcatttctactaaaaaaaaaaaaaatagccaggggtcatggtgctcgcctgtaatcccagctactcaggaggctgaggcagcagtatcacacgaacccaggaagcaggggttgcagtgagccctgatcgcaccactgcactccagcctgggcaactgagtgagactccatctcaggaaaaaaaaaaaaatacagattcaaaataactatatcatgaatcctaaagtcagtctactatcatttttggtctatctggtttgacttccttaggttggcaattctgtcatttttctgaacaggaataaaacatttttttcctttttcaattacataagcaagacacaacacagtatttaggaaaacactattttatgaccttcaccagccaagtctaccaatcagcaaatacacacatcctgatcaggaatacaatttaggcttggttcctgaaagtagaacttaaaatgggataatgagcagctctgtgaggaaaaaataaccctgtctctccatcttcccaagcttatgattgttcaacacagtagaattaagaagaaggtttaaatgtcaattatccatacttttaggactacttgggagggggtggaaaaagttacctctttactgatatttaaatatcctacaactttttaataaaaataatatacagttgtgctcactagcataccctggatccactgacatgtaaaaacacaacattgcggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactctgtctcaaaaaaaaaacaaaaaaaaacaaaaaaaaaccacaacattgctgtcttacaacctactctttccggtacccaatactccacaatatttttcatctttataattaggctactaaccacctaagagaactgttcataattgatgacagtaatgaaggtgcctcagaaacaatgaacaggttcgcttctgattgctgcaaagtacctgggtagctccgtcacctgcaaaggcagaggaacaatacccagggtctaataattgcttactcaaactaacaaaaggagaaaaaaaaaagaggaagtagagaaggggcagcactctaaattatttaatgtgattcccatgcttgggaaaacactgaattcatgcaaccagcaggagctggaatgctcctcagtataaaaggcaccatataaaaagaattactgaatccaaatgcaatattcattttcatttaacatccaactacctagaggattgaggtaatgagtctggggctctatttcacacttaaaagctgaagtgtgaagccagaggaaaggactggcttagcagatcaaaatgtaaaaggattagcccacaggacaaaaaaaatggtccaaaaaaaggaaaaaatggtcttaacatcccaaagatatttccaaaaattctttctgattttctttcctttgaccaagacagcacaattttccctcccttccttagtgacaatgatttcaaagacagatttccatgtagagacacgaagtctggagttcccaggctaatgtccgaaagcaatggcactgcacagtggggaccttgccattcaccccaaagactgaaactataaagtctgaagattacacacaagcatgtcaccattctcaccgcagcagtctggggaggagatgaagtcaacgggaaatcagaactttaaaagacagtgtctttacttgacaaaatgattccttctttacttcaaaggttcaattcacacatgctcagaatcatgaaacttcagatctgaaagggaccctagaatctgcacaatagtccagtctcctcagttcacagaaaacaggaaaaaaaattcatacctagttattggtaaagtcagacaggagcccaaacctaatctcagtttaatatgagcatgagaccaagagggcacctcctatggttataaataagaatcataaggccgggtgcagtggctcacacctgtaatcccagcactttggaaggccaaggaggacggatcacctgaggtctggagttagagaccagcctggctaacatggtgaaaccccatctctactaaaaatacaaaaaaaaaaaaaaaaattagctgggcatggttgcaggtgcctgtaatcccagctactcaggagggtgaagcagattgagaatcacttgaacccaggaggcggaggttgcagtgagccaagatcgcaccatagaactccagtctgggcaacaagagagcgaaactccatctcaaaaaaaaaaaaaaaatcataaacataaggacctttgtgtcaagctctgtgctaagcccttttatgtgcatattctacttaattctgacaagtagcctgagaaaggtagtatcctctatttgaaaacaaaatgaatctgcccactccaagctgatctgaacccagatctcttttcaaccacattgtatgtgcttcaggaatatcttaataattctcaactttgggcaagttaatgactcaacttgacttatatgatcatctataaattgacagatgtagtcaaaagtttagaattcaaagatctcccataactgataacatgacactcaaatgctgggtacctgggtagctccaggattttaagtggatcttaaaatcccattaatttttcctcacaattttctacaaaacataactcgtgtgcaaaggcaagcatacctttattggctactagaaagtgaagaacaactgcccttttccccacagtgcacataggcctgcctcttctcttcagcccacacccaacctgcttgcttacgattatctgtttgtcttagccagtggtaacctccctttttctctatttctctgacaggcctcagcagcattacattgctcacttcttacgtgctaaggtttttctttgccttatgtgattagatgtgccgaacatacttccaagatctaaaaagcagcaaaatttagggaagcaagaagtcaattgtattctggccttctgctgctttggaatttctgctctctcagagagctctaaagaggcatggcaacacagagcccctccttcctggtgattattatacaaggctcccactggcctgttcagctggggcggggggagttgatgctggaacagaatcatctgccggctaggtatcctggaacagtaattaatactgtttgaatggctgagactatccaaaaccaaccactttctttctactaaagaaaatttcaactccaaacccaagacctggcttccaatatagcaaaaactccacaaagagaacataaaacatcaccaaagtcctggtcaaaagtggtgctgtttacttttgtaacatcaacctgttctccaaacacggcttcctcctaagaagaagggacaacactatactcaaatatgtgcgcaagagtgcatgtggatttggagcaaaaaaaaaaggtgtccttcacgggataaggctctttaattctctgaagtgaagtaacccatatttccccatatgtatttcattctagaaagctcagaaactgagtgtgctgagggattcagagggctttttcatgtcaagaaaaaaaaaaggctattttcagactacacttgaatggggaaaatctgaaattttcatgtggttattaggaaaagttgtatttgattatataaaacatgtatcttctctaaaatcgttgtttggagacagggtctcactctgggtacccagacagagtgcagtggttcaatcatggctcattgcagcctcgacctcccaggctcaggtgatcttctgacctcagcctcccgagtagctgggattacaggcaggcaccacatccaactaatttttttgtatttttagtagagacgaggtttcactatgttgcccaggatcgtcttgaactcctggacacaaggaatccgcccatcttggcttcccagagtgccgggattaaaggcatgagccaccttgcccagccttttttttttttttttgtctaaaatcttaggaatggccgggcacggtggctcacacctctaatcccagcactttgggaggctttggtgggcgtatcatctgaggtcagaagtttgagaccagcctgcctggccaacatggtaaaaccccgtctctactaaaaatacaaaaaaaaaaaaaaaaatagctgggcatggtggcaggcgcctgtaatcccagctacttgggaagctgaggcaggaggatcacttgaacccaggaggcagaggttgcagtgagccaagatcataccactgcactccagcctgggtgacagagcgagagacttcatctcaaaaaatagtaagataaaaataaattaaaatcttaggaccaatgtttatgtagaatgtaaatgaattatcaacattctatatatgaaagcatctcactagctttattgaggtatgatttcttaaaaattctctaaaagattgactaagatgcagttctagtttttcaaagggctttgggattttttgaaagtatcagatcattgaaatcaagtcacttgctcaaggtcattcgatcaaatcaggtaagattagaattactggctcctgccttccaaaagccagccataaatcaaatttctcttggaactaagcaggccaaaaatgtcaaaatcattccccatctcttttcttcagtaatcaaggaaagagaaaaattagtttaaatgtagaacagaatttcaattaataaaatgtcatcggccaggcgcaatggctcatgtctgtaatcccagcactatgggaggccaaggtgggcagaccacgaggtcaggagttcaagaccagcctgaccaacatggtgaaaccccatcaaaaattagccgggtgtggtggcaggtgcccgtaatcccagcaactcaggaggctgaggcaggagaattgcttgaacccaggaggcggaggttgcagtgagctgagattgcgccactgcactctagcctgggcaacagagcgagactccatctcaaaaaaaaaaaaaaaaagtcatcaatgcataaacaattacccctaaccatgcacaggcacctctcttgaaaccgataactgtttcgacaatttgctaaggtcagtaacctctacacaaccttgccatatgatggtaccataaacttattaagattttaaatcagcacctcatatgtatatttataaatagctcgcttctgttatcttttaaaagacctgatcagactggagtacggaagtactctgagctctcggatttttttttaagttaacaggtcataaataagttcaaaagttttctgcagaaccctgaagggaatagggatatttcaacattgcaaataaaacaagtgattaaataaatgagaatcataaaggccagagggtagagggttgaagagaagggacatcacatttttatgcaacattattaccttgctccttatcaaatccaccactttctctctttcactctctcactttctgtcccaaccttctccttttaaattgctgatataaaacactacttccaaaattaacaatacaaacacaactcccggccaggcacggtggctcacgcctgtaatcctagcactttgggagactgaggtgggtggatcacttgaggtcgggagttcgagacgaacctggccaacatggtaaaaccccatctctactaaaaatacaaaaattagccagtggtggcaagcgcctataatcccagctattctggaggctgaagcaggagaatcctttgaacctggggggcagaggttgcagtgagctgagatcacaccatttcactccagcctgggcaaaagagcgaaactccgtctcaaaaaaaaaaaaaaaattccaacgaagtcgtatttttaaaacattaaatggatcaaatggtattattatagtagctgagggcattttatattttttgcaaacacactattaatagtcttatttagtaattttcctcatatccaattttctatgtgagatggtaccccatttcacggatgactctcaagtccaagaaaagtttcctttgctcttagaatacgggtcacccacattaagtggcattagagctcaaaaatactaagttaatggttaggctgaaattttggctgggttacagtatacatggacaattcataacatttatagctacatgatttttcttatttcaaattcaagtctactatttctgaatctcttggagtgatgatatctctagcccttgagcacaatgtagccacagggtatacaaagcaaatcaaaagcaagcactggaaaaagttaaacctagaaggaaatataagtccaataattccactgtgccagaaaacagaattgtcattgggaaatttattaaagtgaactacatgaaactgctgatatacaactgtttttgacctgcaaaaacagaaatttcatatggctcaacctaatgttattttctgttattttctctctcttttttttttttttgtgtgtgtgtgtgtgtatgagacagagtctcactctatcacccaggctggagtgcaatggcgcaatctcggctcacagcaacctctgcctcctgggttcaagtgattctcctgcctcagcctcctgagtagctgggattacaggcacctgccaccacgcccggctaatttttgtatttttagtactgacagggtttcaccatcttggataggctggacttgaactcctgacctcatgatccacccaccttagcctcccaaagtgctgggattacaggtgtgagccaccacacccagccaacctagtattattttctaagctcattttaataactattcaaataaggtcttcataacccaaggaacacaaaacaaccttctatttctccagattgccttaaccttgaaaaaatttgccgccccactgtccaaagctagacattctaaaaatttaagttcaacagagcctgtgcatcatagtgagatcctgtctctacaaaaaactgttttaaaagttagccaggcagggtggcatgtacctggagtcccagctactcaggaggctgagggaggaggatcccttgtgcccaggagatcaaggctgcagtaagctatgagcatcactgcacgacagcctgggcaacagagactctctatcaaaaaaaaaaaaaaaaaattagtaggaagggcaaacagctaaatgtaactactccacatcctttttttattgttcccctttctcacgaacaaaatttccatcctaagtagaattccccttcagaaggcttacattcaaggggatacagtactaatgaaaatgtaagtgctctgcctctttttcagctatcagtgatataggattctaggcatggcagtagcacatcgctttacacaggggttccactgacctaaaaatctactgttgaggaatcttaattaaattgataagttccatttctgttgaagaatctggcttctaacctttctatcaaaagggtgattaccatcccagtgggatatagttttccatttagatatagctgatttatggactcagaccagaagtacctgtcactttcacaaaaggagaaaaaaaggattatggctctaagactgcctctaggtccaaatcccatcttttcacacccatttttattagagtctaatagccaacatgctaatgaactcttttctcagttaattccactaattagttatctcttcttgttctgccagaatcccaacccttttacaatctactcatcaaatccatcaggccacatattatgccttcctagaggaacacttttcgtgatgacactttgtaaacaaggcaatctgatgctgcctgttctatcttcccagatctagttgatagttcaaaacatcaacattaaccacaagtaaaatatgcttaaaaaataatcaggagacgatctcctgctctatctggaaatttctctattcagctagttctgcgttgacaggtcaacagagaatggcactagttattgctacaatcctaaaaggcatttccctacagctaaaccatcaaccctttcctaaaatccatataatccaaaatttttctagcagaatttactctccctgcccctaccccagcagcatcttctgatcatttttcaccataaactgaggtttcctcatagtgatgccaagtcaggcaaacacattccttaagcgttccacctaactcccttcttcctggaagttacatgtaatagctgcctttatttacttatttttaaaactcttcaagcaccaggtacagtggtaagtgcttttaaagaacatgtatctacttccatccttaacactgtatgagattgggactcacattcccattttacagaggagaaatgcaaaggcttagtaacctgcccaaggtcatacagggcagagattggaatccaagtctgacctctgtgtcctccgctcttaaccttcatgctgtctttccttctgatctcttcctgtcctaactggtgccctgtggtcttataaaagactatgcttggggcaggcgggggaggggtgggagggtcagtttctccagagaccgcctttcctttaaaggataagactttgaaaagaaggagtacccattacatctttcctccatgctcccccttctcacctggtaccatttcccaaaggccccaatcatatccccttctctacggacaatttaaacttctcctttgtccgcagagcaggcactatccaatactgaagaaccacaccatctaccctcaaggctaggagagggcagaagtggaagaaagaacacagacagcaccccttccccaggtcttcagttgagaaagaagctgtggctgaaagtctggggggctgggggcaaaggtgacaaggatgtgcccttgtgggtacgcgaggtgggggggggggagatggggaagaggcatgggacgctcaggggattagcaggagattgaatgggggtggacctctgtaaggggaaggggggtgccaccggcaggcagagagatcaggccactgaagaggtgaacgtgagttagggaggaggacctggaggtggatgtaataggggaagtagaggaagaaaggggagggagggggctcacgggagcaggaaacgatggagtcatggggagtgggggaggatggatgggagctagaaggtggggcggcctgggacccgggcacatgggctcggcgaagagcgggcgcgccgcgggggactggggtgcggggaatgccgggaatgggggttcgaggagaccccggggaagggaaggggaagcgggagttctcgagcagaggagcgggaagtgggagttccagcgaggcaagagcgggaagggggttccggagcaaggggcgggcgtgaaggtacagtcgggttcgcgagggtggcgttaggaggggcggggtgggccggaggctggcgcgggagagggatcccgggcgcctgttggggtgcggagggcaggaatgtcctggcgtccccgagagccgggccaggactccggagtcttcggaggaccaggctcagggccgcctcccggccggggccccttagggaggggcggggattccccgggtccctcaaggccagagcggcagccgccgcggtcccaagcccccttcctacctatgccgggcgccacatagacgaagtacagcagcgaggacgagagagaaaagaagaagagcgcggcgagcagcgagcggcgcggcagccgcagcagcccccggcgggcgcgcatgctgcagccaggcggccgctagagagccaggccgggcctgctcccgcagctccccgtccgccgcctcctgggccgccgccgccaccgcctgggcctcggccaccgcctcccgggcctcgcgggccgccactcgccgccgccgccgcctcgccgctcccagccgccggccgtcgcgggccgggccacatgaagcgggcgggggccagagcggccccgagcgggcgcagcggcgggggcggaggcggggcgcacgcgcgggaggcggggccagtgccgccgggcaccgtcgcaaaagacccgcgcgcttgcgctcgccgccgaccctcgctcggcgcccacagcagcccgcatggagtaatcgccaaatggcgacagaccctctcccagtgcggccaccgcccaggctttcggggaatgtctcccaagtgctccgcgctagctcgtcccccatctcgggggccaaggggccatctacaaagtctgactcatctcgttgcccactgcagcagaagagtggggactgcaaggcttgggggttcggcctggtatacaccctcattcattcattcattcattcattcaattcaccatttatttattgaatgccagacacagttgttggcgctgggcatgctacagagaaaaaaaacgataaaaatctctgtctacttgaaacttacattatgtgagagataaaagaaacaaatcagctagtaatatcaggtactggtaacacatatgaatacgataaaacaggaggatgtattgcaggcaggctggagtggtcaaggaaggcctcactgagcagtgacacgaactgagatataaaagggtgagaaagcgccagcttttttgaataagctggggaaaaagcagtcataccagggggaacagcaggtgtaaaggccctgaggtaggaaaagggctgatctgcccccgagttgaatccaaggccaacatggataaaatccagtgaagtagggggggaaatagggatgagcttggagctgtagtcagggatcctactgtatcagaaatagcataatgataacaattgtcaatgtctctagacttctgctgagaaacatggacttcactcatgccatgaaattcccccaccagtcttgagatgtgtgctgttattattactatcatacaaatgaggaaactgaggtttctagatggaaaggcaattcacccaagccttgcagtaagggcttaaatcaaaactggcctgtctcccatgtcaggcccttgacctctaggttgtaactgtctcagcagtctgtatgacctctaattcttatcctgcaggcaaatcggtatcctatccccatcacctgggtatgggaccatatccaaaaaaatgctttcagatcagcatcagctcaaaggacctcagaaggcaatgaacagtcctagaaatttatggcaagaagcagtagcctcaaggagctggactgaggaggccagtgtccctgtgtagacatatctgaaactagggtactgtcttggaatgccagaagcagtggggaggggagaggactttgcagggattctgtgagaatcaacaataattctgatttatattcctaaagtgatttctactttttacagtgtttctttgatcctttaagtggggagtctagagccacactgcccaggttctctgactcccagcttttccattgttagctgtgtgacctcacgcaagttaaactctctgtgcctcggtaaaatggaggaggttattagcaacctcatcaggttgttgcgaggatttaagtaatacatgcaaagtgcacatagtaagagtgcttagctgtcacctaattcaatacccctggagaatggtatggtggaagagaagaggcttaaacgatcaaaaaggaaagcagagaattttgactcagatagatgtgagttcaaatctcggcttggcatctcctggctgtgtgactctgggaaagtcacttacctctctgagcttctctattcatcacctgtgaatcggacccagtgctgcccaccccacggggatgtgatgtggattcgatgaaatagtgcaggtaaggccctggaccagaaatcccagactagccggaatcatctaacttgcaaatagtttttgttggcccacacaatggcccctcccaaccctcgtatctatgaaacattttcaaacatacagaaaagttgaaagaatagtacaagaaacatctgtacactccccacctggatttgatcattgttatcatttttccacatgtatgtatctatattcatatgttgaaaatttttattttttgctaaatatttaaaggtaggctgggcgattacacctgtaatcccagcactttgggaggcaaaggcagatggatcgcttgagctcaggagtttgagatcagtctggccaacatggcaaaactccatttccacaaaaaatacaaaagaattagctgggcgtgatgacgtgtgcctatagtcccagctacttgggaggctgaggtgggaggatctcttaagcccaggaggtggaggttgcagtgagccaagatagcgccactgcactccagcctgggagacagagtgagaccctgactcaaaaaaacaataaaaaaaagtaagttgttgccttactagtacttcatgccttaatacttcagtagcaaatcctaaggaaaattacattatccttcaaaaccacagtaatactaagagaattaacaattataccataacattctgtaacatccagtctgttctggatagacagagaaagagaaaccttcctacatttaaactatgtaccaatgatcagtctctatttctgacctatctgaaataacaaggcatcaaaataaattggttatgttttaggccgggtacagtggctcacgcctgtaaccccaccactttgggaggccgaggcaggcagatcacttgaggtgaagagtttgagaccagcctggccaacaacatgaaaccccatctctactaaaacatacaaaaattagctgggcgtggtggcacgtgcctgtaatcccagctactcgggaggctgaggcaggaggattgcttgaacctgggaggcagaggcagaggttgcagtgagccaaaatcgtgccattgcactccagcctggacaacagagtgagactccacctcaaaaaaaaaatgcaaaatacaaaaattagccaggcacggtgtcaggcagcctgtaatcccagctatttgggaggctgaggcacaagaatcgcttgaactctggaggtggaggttgcaatgagctgagatcataccactgcactccagcctgggcgacagagcaagactccgtctcaaaaataaataaataaactggttatggtttttgtctgtttgtttgtttcagtggagtttcgctcttgttgcccaggctgcagtgcaatggcacattgtctgctcaccgcaaccttcgccttccaggttcaagagattctcctgcctcagcctcccaagtagctgggattacaggcatacgccaccatgcccggctaattttgcatttttagtagagacagggtttcaccatgttggtcagactggtctcgaactcctgacctcaggtaatctgcctgcctcgacctcccaaagtgctgggattacaggcatgagccaccgcctccggcagtttatgtttttaaatggaagaaaaagaagtatgtcaggagtatccagggatccctacctcaaactccttcctccacactactttttcatctccaagttaggtttccaactcactaaagcatgtattcattatatattcatttgactattcagctcctcagacaaactcactgtattctaatctctgctcaaatgttaccgtctcaaaaagacctttcctctaaagtagctttcttctccccatcccagcactctctatccatagccttcctcagcttgatttttctccatagcactttttatcccctgacattctactatacatatacgcgtttacttgttcattttcttctcccagatcagaatgtaaacttcacgagagcagggatttggtttcactctctgctgtatccttgcacctagcacagtgctcagcagccagtaggcgctgaataattgttgaaggacgacaggtgtgcagtgactgtgtgctgggcatggcagatgcaaagatgactaagacattcttgcagcctagtgacatatgagctacaggaaagtgactaactgagggacactgtcataagggcaggactcagcatggctggcagtaggaaaaggtgttctgtgagattctagatggtctttgaagggacattgagacaggtttgctcaaggggcagtgagaagaggcctgcctggttggagcagctagtcctgccaaggaaaagaaagaggtgaggggtgaggctggaggagtgaggcctgaccctgtggctcagcatgggccctggaattagatggatctggctgccagtcttccttcctccctgccctcactctgtcatcttggcaagtcacttcacctctcggaacctccatttccgcatctgtaaaatggagatcagacagttccttctttctaggattgtgcacagattacaaatagtatctctataaagggcctgatatgtaggaagtgctcaatccatgggagccatcactattcttaactttttcctctgagccatagagagcccttgaaggttttagcgcaggggagtggcctaaagaaagggaggtccttggtgaaatctcaggagagcacaggttgggcctcttgtgcttgtcaacacccaattgcaggctagctgaaatcacacacataaagaaaacaatccggcagggcatggtggctcatgcctgtaatcccagcactttggaaggctgagatgggcaggtcacctgaggtcaagagtttgagaccagcctggccaacatggtgaaaccccgtctctactaaaaatacaaaaattagccaggtgtggtggtgggcacctgtaatcccagctactcgggagactgagacaggagaatcacttgaacccaggaggcggaggttgtagtgagctgagatcgtgccactggactccagcctgggcaataaagaacaaaactccgtctcaagaaaaaaaataaaaataaaaaaagccggtgcatccttccctctacttttccttctatcaaataaccatcaatgttgttcagagcagccacccaccagctaagttccagaatgaggaggagatgctcccaactccattttgccaacaatgacacgtagcatgagcaataaataaagcctctgagatataggggctttttttttttgagacaagtcttgctctgttgcccaggctggagtgcagtggcatgatctcaactcattgcaacctctgcctcctgggttcaagtgattctcctgcctcagcctcccaagtagctgggactacaggcgtgcaccaccatgctcagctaattattgtatttttagtagagacagggtttcaccatcttggccatgctggtctccaactcctgacctcaagtgatctgcccgcctcggccgcccaaagtgctggaattataggcatgagccaccgcgccaggccaagggctatttttaatacagaaaacctggcctatccttacttatcataaatataccgttctgcaacttgctttctcctgacattatttttataagatatttccataatgatacatgtggctcaagtttattcattttcactgctgtgtaatattttatcatataacttggcctcaccttttaaaatcctttttcctaatgatgtctatttaagtttgttccaattttttcctcatactggtccataaatccttagctacaattcaaattccaggaaacctaaaaatggaaggctttttataatttatttagcagcaagatctgacctgatttgaacttctttagtggcaaaacctgacctgaatagacagaaagctatttataatcattatgccacttaatgtgaatattcatatgttccactgaggaaatatttagtgtttttttttttgttttgttttgttttgtttttttttttttttttgagacagggtctccctctgtcgcccaggctggagtgcagaggcgcaatcacagctcactgcagcatcaacctcctgggctcaatcgatcctcctgcctcagcctcctgaacagctggtactacaggcatgggccaccataccgagtttagatttttgcttacaggatgaaccagtcctctcaaggggtatgataggagatttcatgaatgcaccatattgtctttcaaaattctaagaatttctttttttttttcttttttgagacggagtttcactctttttgcccaggctggagtgcaatggcctgatctcggctcaccgcaacctccgcctcccagattcaagcaattctcctgcctcagcctcctaagtagctgggattacaggcatggaccaccatgcccggctaattttgcatttttagtagagacagggtttcaccatattggtcaggctggtctctaactcccaacctcaggtgatccacccacctcggcctcccaaagtgctgggattacaggcatgagccaccacgcccggcctcaaaattctaagaatttctaaaattcaaaacacgtttagccccaacggctttggataagggatggtggacaggcacaaacatgactgcgatgtatgcgtgtggcagaatgtattttccaaagatgccctcaacaatatttcctgtcctcatgctcttctagaactttctctaattcctcttcctgtgaatctgggtgggattgtgaatcatctataaccaataaaaagatgaaaatggccaggtatagtggctcatgtctgtcatcccagcactttgggaggctgaggcaggtggatcatctgaggtcaggagttcaagaccaacctggctggcatggtgaaaccccatctctactaaaaatacaaaaattagcccaagcgtggtggtgcatgcctgtaatcccagctacttaggaggctgaggtgagagaatagcttgaacctggcaggtggaggttgcagtgagccgagattctgagattgccctactgcactccagcctgggagacagagtaagtgagactctgtctcaaaaaaaaaaaaaaaaaaaaaaaaaaaaaagatggaaatgatgctgcacaatttgtgaggcaatgcagcttctgacttgatcactgggacactcacctttggagcctggaacccctatgctgtgaagaagcccaggccaagtggagaggccacatacagatgctctggtcagcagccctggcagaggttccagatgacagccagcatcagccaccaagcatgtcagagaacaaggctttagatgtcccaactcccagctgtcaagtcatcctcaccctttaaaccttcccatctaaagccccagacaagctgtcccactgtgccctttccaaaatgataaaatggttattgttttacacaactaaatttgggataatttgttatgctgcagcagtagtaactggagcaacacgcttttttttttttttttttttgagagggagtcttgcttttttacccaggctgaagtgcagtggtgcaatctcagctcactgcaacctttgcctcctggcttcaagtgattctcctgcctcagtctcccaagtagctgagattacaggtgcacgccaccacgcccagctaattttcgtatttttaatagagacagggtttcgtcgtgtcgtccaggcgggtctcgaactcctgacctcaagtgattccccgcagccccctgcctcggcctcccaaagtgttggaattacaggcatgagccactgcaactggctcaacacgcgtctgtatgtaatttgtgcatgtggcaaaaatgtctccaggtcacatggtttacaagagaggatttggtgaacaggtgaggtatgcatatcttctgctttactattttccaaattgttctcaaaaatgcttgtagcaatttatattcctagcagcagtgaaggagggcttcctttatttcctgcttcacccaccgttactgtaatcagaattttccagggtttggtccttctgccaccaatcccctctgaagagagagagtaaggtaaaagttagcaaaggcctccaagagctttgattctgtacaggactatgtctttgctgtcaaaaaaaactgacttatagccaggcgcggtagcatgagcctgtagtcccacctactcggggggctgagacaggaggatcacttgagtccaagagttctgtgttgtagtgtactatgtcatttgggtgtctgcactaagttcggcatcaatacagcaacctcccaggatggggggaccaccaggttgtctaaggagggatgaaccagcccaggttggaaatggagcaggtcaaaactccagtgttgattagttgtgggattgcgcctgtgaatagccaccgcactccagcctaggcaacattatgagaccctgcctctaaaataattaaaaaattaaaaataaaataaaataacccgggcatggtggctcacgcctgtaatcccagcactttgggaggccaaggcgggcagatcacctgaggccaggagttcaagaccagcttggccaatgtggtgaaaccccgtctctacgaaaaatacaaaaattagctgggcgtggtggccggcgcctgtaattccagctactcaggaggctgaggcagaggttgcaatgagctgagatcacaccatcacactctagcctcggcgacaacagtgaaactctgtttcaaaaaataataataataataaaaataaaaaataaaaactgacttatatcccttctctaaattctcctcagtctttcctatcctgtagaggaaggcctaaggcatgacaagattgctcctagtattgcctgatataactcattctctcattcaacagatattagtatttatcaagtactggccgggcatggtggctcacacctgtaatcccagcactttgggaggccaagacaggcagatcacttgaggtcaggagtttgagaccagcctggcctacatggtgaaatcccatctccactaaaaatacaaaaaaatatatatatatatataattagccaggtgtagcggcaggtgccggtaatcccaggtactcgggaggctgaggcatgggaatcgcttgaatctggaaggcagaggttgcagtgagccaaggtcgccccactgcactccagcctgggtgatagagtgagactctgtctcaaaaaaaagaaaaaataataatatttatcaagtaccaaactagatgccagacatttttctagatgctaagagaaaattatgatgataataatgatgatgccactgccatctagggaccaggtatttactgaattttttagtcacccagcatccattcacttgacttctgaaacagccagatttccttctctccttgttttcagtctatgtggttctctgaggttgttaactccatttccatctccagacatgatatgaactagcctggccagtcagaatattatattccttttgcaacagtgattggttcagggctgagcagaccagccagagccaatgatgctaaatgtccagctttctttgtgcctttggagaggccaactttctctttcatgctagacataaacatgacaggttgtgaggccacagcaatggcaactgttttatcaacatgtggaacctgagaatgaaatgagcatataaacagactgatacaaacagcaaagagaaattgagtcctaatgatatagtttgactcttgaattcacctagtcctaacctgcctttctttccttccccagttttgcatctgctgaggtttttacaagtgtgtttttttaattttaattgaatcatagcacacatacagaaaaatacacattgtaacaaaagtatagtttgctaaatttttacaaatggaattacccatttaaccaacattcacatcaagaaataaggacatgatatgatgtatacatgtacatcacatatgtataggtatgtatatgtatatgatatgtgtatgtatatgatgtacatggtctccaatttatgatagtttgacataccactttttgatttcatgatggtgagaaagtgatacatattcagtagaaactggacttcaagaaggccgggcgcagtggctcatgcctgtaatcccagcacttttgcaggccgaggcgggtggatcacttgaggtcaggagtttaagaccagcctggtcaacatggtgaagccccatctctactgaaaatacaaaaaattagccaggcatggtggtgcgcacctgtaatcctagctacttgggaggctgaggcaggagattagcttgaacccaggaggcgaggtagctatgagccgagactgccccactgcactccagcctgggtgagagaacaagacttcatctcacaaaaaaaaaaaaaaagaaagaaactggacttcaagtacctatacaaccactctgtttttcagtttcagtacagtgttcaataaatgatatgagatattcaacacttgattataaaataggcattgtgttaattttacccaactttaggctaatataagtgttccgagcacatttaaggtggactaggctaaactaagatgtttggtaggttaggtggattaatgcattttcaatttacggtattttcagctcacaatgggtttagcaagatgtagctcctctgtatgttgaggaggacctgtgctgttctgtctggctccgtttgctcaccatgtttgtgagattcatgcataccgatgagtgagattgtaaaaccattcattttaattgctgaatagtatcctgttgtgtgaatacaccatagtttactttccagtcaactgctgtcatctggcatttggatcgtttctagttagaggatactaggaataaagctgctataagctccctgggacagtggctctcaggcttgtgaaatactctcttgatgtagtgtattagtcaggcatagctggggggctcacatgatatcagcagccttagtttctctcaatatcttagttctgcttccctctgagttggtttcatcagattcatgtgttcctcctgaccagcttattctcagctgctccaggcttccattccccagcccagtcacttagccaaaaaaaagaaattttataataaagtctcattggtctggcttcattcatatgttcctccccgaaccgatccctgtgattaaagggatggagtgtgctgattggacagaagtggtcacatacccactccccaacctgcccccaccctggagccaggaagcaagatcagcttcctgtgaaccacaaggttgatgtagggaggggtggctccccgaggggaaatcaaagtgcaattattcaagtggaattgttgctgggcaggcaaaaacaacagatatttgtggaccacaccaacttttttttcaatgccttcatgcctttaggtgctctgtttctgctaccaggaaatactgtgttctctttctcctcatcctctaagatccagcttaaatatttttcccatcctaaaacctcccagaatttttggacttgattctggatggatgttctttttttctttctttcttttaagacggagtctcgctctgttgcccaagctggagtgcagtggcgctatctcggctcactgcaacctccgcctcccaggttcaagcaattctgctgcctcagcctcctgagtagctgggattacaggcgcatgccaccatgcctggctaattttttgtatttttactagatacaggatttcgccatgttggccaggctggtctcgaacttctgacctcaggtgatctgcccaccttggcctcccaaagtgctgggattagaaaggcctgagccaccccgcccggcctggatggatgttcttaacctccatttactctccttctgttgaaagaggctcaaaagcttaaaacagcattccacaggctctcttgcagctatgacagtgggaagttaaattctgtcagttagattcatttgcatgagatctggaggatgggagagagggagaggtcgtcttgctggagctgtgtcagctaagggagcggttctgcaggtgggaggagcatgtacagtggagtccactgtgcagtccccacttaggagggtgtgaggtagtaggatggaggccatggtggtggcagggaagcagcagtttggtaaccttgggaacaaggccttgctggaggaaccttgaaatcaaaagcctgaaatggcccctgacttctactcttccagacctcctaatgattttgtaagcacctatatccctgtattaaatcttttttatttattattattattatttaaattatagacacagagtcttatactgttgcccaggctggtctcaaactccgggcttcaagcaatcctcccacttgggcctcccaaaacactgggatcacaggtgtccagcctcaaaattcttttttgggccaggtgcggttgcttccacctgtaatcccagcactttgggaggctaaggtgggtagatcacttgaggccaggagttcgagaccagtctggccaatattgtgaaaccccatctctactaaaaatacaaaaattagccaggcatggtggcccatgcctgtaatcccagctactcgggaggctgaagaaggagaatcgcttgaaactgggaggcagaggtgcagtgagtcaagatcatgccgctgcactccagcctcggtgacagagagaaactgtgtctcaaaaaaatacaataaaataaaagattttttaaaaaagcacttgaatagcacttactctgtgtcaggcactagtctaagcactttattaaaaatttatggaccagacatggtggctcatgcctgtaatcccaactctttgggagggcaaagcaggcagatcacttgaggtcaggagttcaagaccagctcgaacaacatggtgaaaccccatctctactaaaaatacaaaaattagctgagcatggtggtgtgtgtctgaaatcccagctactcgggaggctgacgaaggagaatatcttgaacccgggaggtggaggttgcagtgagctgagatcgcaccactgcactctagcctgggcaacaagagtgaaactccatctcaaaaaaaaaaaaaaaatttacaaccaggcatggtggttcacacctgtaatcccagcactttggcaggccgaggcgggtggatcccctgaggtctggagttcaagaccagcttggcctacatggtgaaaccccacctctactaaaaataaaaaattagttggatgtggtggcacacacctgtattcccagctactccggaggctgaggcaggagaattgcttgaatccaggaggtggatgttgcagtgagccaagatcctgccactgcactctagactgggtgacagagtgagacttcgtctcaaaaaaaaagaaaaaaaaaatttacttaatgggctgggtgtggtggctcctgcctgtaatcccagcactttgggaggtcaaaggggacagatcacgtgaatccaggagttcaagaccagcctggccaacatagccagccaaatttcatctctactaaaaaatacaaaaaattagctgggccgtggtggcatgcgcctgtagtcccagctactcaggaggctgaagcaggagaatggcttgaacctgggaggcaggggttgcagtgagcccagatcgctccattgcactccatcctggtgacacagcgagaccctgtctcaaaacaaaacaatacaaaccactgaacaaacaaaacccttaatctttacaacaacattttgaggtaagtactactgccaccctcatttgcagatgaggaaataaaagtctagaaggattaagaaatttgcccaaggtcacacaactggtttcttataaattatgtaaggttatgggtagatttcataatgccatggggaatgctcttgatgggaacgactgtccttgaaggcaagcactgtctttttttcatatttgcaccgcagtgcctaaattagcaccctaagcacttgataggtgtttggtaaatattggttgaatgaattaatgaaactatttatgaattcagctgagtctgctgtgaaaagaaaaaaaaactaaatattaaaaggaattcagagtatattttcccactagagcacaggtgagcaaagttcttttataaagaggcagagagtaatttttttgtttgtttttttgagaaagagtctcactctgtcacccaggctggagtgcagtcacatgatcactgcagcctggacctcttgggctcaagtgatcctcccaccttagcctcccaagtaactgggacacagacttacaacactatgcctggcaaagattttttatttttttctatagaaacaaggtgtcactatattacccaggctggtctcaaactcctggcctcaagtgatcctcccaccttagcctcccaaagggctgggattagagatagtaaatttttttttttttcgagatggagtctcgctctgttgcccaggctgcagtgcagtggtttgatctcaactcactgtagtctccgcctccagggttcaagcaattctcctgcctcagcctcctgagtagctgggaccaccatgtgccatcacacccagctaatttttgtatttttggtagagatagggtttcaccattttggctagggtggtctccagctcctggcctcaaataatctgcctgtctcagcctccccaagtgctgagattataggcatgagccactgtgcccagccaagacagtaaatattttttattttactggctgtacaatctttggcacagtcaattaattctgctattctatcacaaaggcagccatagccactatgtaaacaaaggagtgtgtttctgttccaataaaactttatttacaaagacaagtagcagaccagatttggctcatggattgtactttgctgaccttgccctataagatgagttttaatatatcaaaagatttactgtagattactgtacttagtaaaatctttttttgctttgttttgaaaaaattattttattttattattttttttgagacagagtctcactctgtctcccaggttggagtgcagtggctcgatcttggctcactgcaatctcggcctgccaggttcaagcgattctcctgcctcagcctcctgagtagctgtgattacaggtgtgtgccaccacgcccggctaatttttgtatttttaggagagacaaggtttcgccatgttggccaggctgatctcgaactcctgacctcaggcgatctgcctgtctcagctttccaaagtgctggaattacaggtgtgagccaccatcccctgccctctccaacatgtaagtagggaatatagagctaacgtttcaatattgtatttcatttatttttatttttttgaaaaacaaatctttattgtctagaaatatatattttaaaaatcccccacaaaagatgctattctctaatttccccatcttctttttctttctttttttttaagacagagtcttcctctgtcacccaggctggagtgcagtagtgtgatctccactgcaaactctgcctcctgggttcaagcgattctcctgccttagcctcttgagtagctggaattacaggcatgtgccaccacacccggctaatttttgtatttttgtagagatggggtttcaccttgttggccaagctggtcttgaactcctgacctcaagtgattcacccgcctcagcctcccaatcatttctccatcttcttcctcttcttccacacctctgatataaaggacattattacaccttattaaaacttcacccagatgtccagacaatgctccatctatgtattcttctgtatttgcaagctgcatgttcatgtagccatctacagataccaggtagccctagtactccattccccgcttaagtttcaccatccttggctttcctgttactccactgaggaaagatctgggattgagacataaactcatcatcgtaaccacaggcaaatgctatgggcaaatgctgcaggccgctgaccaggctgaccaggctactgactacagcagctaccacaggtcctgagccactgagcatcaggagaaaactatgttcaagattttatagtaagaaatgtatttggtaacattccatgattttatgccatagaaggctcagccaacattccatgattccacatagaagggggtttagctaacattccttaagtctgtacagatgagggtgctctgtagacattccataacgataagcaaaaaggttctgcaaacattcaatgattttatacatggacagatgttctgcaaacggttcaaaattcatgctacaagaaaggattctagccaggcgcggtggctcacacccgtattcccagcactttgggaggctgaggcggtcagatcacctgaggtcaggagtttgcgaccagtctggccaacatggtgaaaccctgtcttcactaaaaatacaaaaaatagccggccatggtgatgggaacctgtaatcccagcgacttgggaggctgaggcatgataatcacttgaacccgggaggtggagattgcagtgaaccaagatcgcgccactgtactccagtgagggtgacagagcgagactccatctcaagaaaagaaaagaaaggactctgtaaacattccatgattctgtatacatgtgggtgttcctcaaaaacagttcataatttgattttttaattttattatttttatttatttttttgagatggagtctcactctgccagcccggctggagtgcagtggcacgatcttgactcactgcaacctctgcctctcaggttcaagcgattctcctgcctcaacctcccaagtagctgggattacaggcatgggccaccacgcctggctaatttttgtattttttgtagagaagaggtttcaccatgttggccaggctggtctcaaactcctgacctcacgtgatctgcccgccctggcctcccaaagttctgggattacaggcgtgagccactgctcccggccgacagttcataattccatatacaagaaggaaaacttatttgttctgacaccctgaaattctgtacacaggaagtgctctgtaaacatttatgatttcattgctatgaataggctttatagatattacataattctaatagatagaaatgggctatatagaacttcttgattttatgcttttgtacacagttggtgattctatagccgaagagcactcttcaaacaattaatgattctacctaaaggagggtacaggtttccctgaacctacctagaacaaagggtactctgtaaagattccataatactaaacataggcaactctgcctgctgttaatgacactacagatagaagggtattctgtaaatattccttgatttcatggcccagtgaggtggtttatgcctgtaatcccagccatttgggaggccgaggtgggtggatcgcctgagctcaggagtttgagaccagcctgggcaatatggtgaaaccccatctctactaaaaatacaaaaattagccaggtgtggtggtggtgaaaccccatctctactaaaaatacaaaaattagccaggtgggcgcctgtaatcccagctgcctgggatggtgagacagtagaatcgtttgaacctgggaggcaaaggttgcagcgagccgagaccgcgccattgcactccagcctgggagacaagagcgaaactcagtctcaaaaataaataaataaataaaaatacaaaaattagctgggcaggatggcacacacctgtaatcccagcttcaaaggagtctgaggcaagagaattgctggaacccaagaggaagagattgcagtgagctaagattgagccactgcactccagcctggtcgacagagtgagactgtctcaaaaaaaaaaaaaaaaaaggatgatgaagctgtctacataaggatgtagaaaagtctctaagatacagtgttaggttaaaaagtaattgtggggccggtcgcggtggctcacacctgtaatcccagcactttgggaggccaaggcaggtggatcacaaggtcaggagttcgagaccatcctgccgaacacggtgaaacttcatttctactaaaaatgcaaaaaaattacccgggcctggtggtgggcgcctgtagtcccagttacttgggaggctgaggcaggagaatggcgtgaacctgggaggcagagcttgcagtgagctgagattgcgccactgcactccagcctgggtgacagagtgagactccatctcaaaaaaaaaaaaaaaaaaaagtaattgtgtatctatataaaattgaatatatatatacatatacatatggagttggatcacaaggtcaggagattgagatcatcctgcccaacatggtgaaattctgtctctactaaaaacacaaaaattacccgcatgtggtggcgcatgcccatagtctcagctactcgggagactgaggcaggagaatcgcttgaacctgggaggcggaggctgcagtgagccgagattgcgccactgcactccagcctggtgacagagcgagactctgtctcaaaaaaagaaaataaataaaaacaaataaattaatttattaaattaaataaatgcagtgtcagggtctatataatttttttatttttttatttttttatttttgagacagtcttgctctgttgtcaggctggagtgcagtcacgggattttggcttactgcaacttctgcctcctgggttcaagtgattctcctgcctcagcctcccaagtagctgagactacaggtgtgtaccaccatgctcagaaaatttttgtatttttagtagggacggggtttcaccatgttggccaggctggtcttgaacttctagcctcaagagatccgcctgcctcggcctcccgaaatgctgggattacaggcatgagccacctttttttttttttggcttttaaataaaagcccgccaggcttttttttttttttttggcttttaaataaaaagagacaggatcccaatatgtcgcccaggctggagtgcagtggagaatccagttttaaagagagcattcaagcaagaagctgtgaatggccactcggaaacacagactccagagaagtggggtgagaactcaaaagttaaaagttagggtcttgcttaggtaggaagaaaacaaagaaatttaacaggattatgacttgttttttaaaagagatggggtctcactctgttgcccaggctggaatgtagtggtgtgatcaggactcactgcagcttcaaactcctgggctcaagccatcctcccatctcagcctcctaagtggctgggattacaggcatgaaccactgaacctgccttcattacattttctatacaaggctggtttatgagctacaacaatttaattagttatggtttgtttttatttcctttctagaaatacacttaaagagtgtatttgacattccatctcaagacagtatgatgatagtcatgaagtctttgtgtgagaaaggtaagagggaagttattatacaatgaagatgaacagtgaagaggaaaggggtcttctctggtgccctttagtcatttacaatattttctttctttcttttttttttttgaaacggagtctcgctgtgtcgccaggctggagtcagtggtacaatctcagctcactgcaacctctgcaggattctctgaggcaggagaatcgggttcaagcgattctcctgcctcagcctcctgagtagctgggactacaggcgcacgctaccacacccagctaatttttgtatttttagtagagacagggtttcaccatgttggccaggatggtctcatctcttgacctcgtgatccgcccgccttggcctcccagagtgctgggattacaggcgtgagccattgtgcccggccgtttacaatactttctaaaacaatgtaggtagagaagagggctaattataatcaaacaaacaaaggtaacgcctgcctaggttacagctgagtaggttcagaagacttgtgtcccacaatcacattcccttaaggcttgaaatattttaaagtctcaacagctcagattttgaaatacttattttcacacttccctgcttaaaagtttctcaaggaccactgcgcctggcccagatggttgtattcttttgagtttctgattggcctctccaaaggagccaaagagatatgcatttatctcagtgagcagaggggtgactttgaatagaatgggaggcaggttggccctaagcagttcccagcttgacttttccctttagcttagggatctgggggccctaagatttattttcctttcacagcatcatagccaaaagtggaaaaaagttactgggtgcagtggctcatacctgtaattccagcactttaggaggccgaggtgggtggatcacttgaggtcaggagatcgagaccagcctggccaacatggtgaaaccccgtctctactaaaaatacaaaaaaattagccaggggtggtggcaggcgcctgtaatcccagctacttgggaggctgaggcacaagaatcacttgaatccgggaggcggaggttgcagtgagctgagctgagatcctgtcactgcacttcagcctggatgacagcgagattccgtgtcaaaaaaaaaaaaaaaaaaaaaaaaagctggtggcggggagcggggagaggaaggtgagaacaatcgaaataccatcaactgatgaatggataaacaaaatatagtataggcatacaatggaaaattagccaaaaataaaataaaataaaataaaataaaagatgaggcggggcttggtggctcattcctgtaattctaccactttgggaagctgagacaggaggatcactcagcccaggagtttgagaccatccagggcaacatggtgagatatcatctctacaaaaaaattttttttaattagccaggtgtagtggtgtgcacctatggtctcagctactcaggaggctgaagtgggaggatcatttgagcaggggaggttgaggctgcagtgagcctcgattgcaccattgcactccagcctgggcaacagagtgagtccttgtctcaaaagaggaaaatgaagaatgatgtactgaaagaagtatgctacatgctacaatgtgcatgaacctttttttttttttgagacagggtcttactcttaggctcaagtgatcctcctccctcagccttctgagtagctggggttacaggcatctacctcggcataagcgggcattaatctttttactttatttttatttttgagacagggtctcactctgtcacccatgctggagtgaagtggcacaatcatggctcactgcagcctccaactgttagccccaagacatcttcctgcttctgtcccccacgtacctaggaccacaggtgcatgccactatgcccagctatttaaaaattgttttgtagagatgaggttttactatgttgcccaggctggtcttgaactcctgggctcaagtgatcctccccacttggcctcccaaaatgctgggattacaggcatgagtcactgtgactggccaggcatccatcttgaaaacattatgctaaataagagaagccagacacaaaaggccacatactgtatgattctatttctaggaaatgtacagaataggcaaatctattatagatgattagttgtctaagactgagagcatggggagagatggggaatgactgctaaatggtatggggcttcttaagggggtgatgaaaatgttctaaaattgattgtggtgtggttgcacaactctgtgaatatactaaaaaccattagattgaatatttatttatttatttagagacagagtctcgctctgttgccagactggagtgcagtggcacaatctcagctcaccgtcacctccgcctcccgggttcaagtgattctcctgactcagcctcctgagtagctgggattacaggtgtgcgccaccatgcctggctaatttttgtatttttagtagagatggagtttcaccatgttggccaggctggtcttgaactcctgacctccggtgatctgcccacctcagtctcccaaagtgctggggttacaggatgagccaccgcatccggcagattgaatactttaaatggaaaaatcgtatcgcatgtaaattatatttcaataaagctgttacatatacgtatattttttaatccaataaaaagtcttggcggggcgcggtggctggcctgtaatcccagcacttttggaggctgaggcgggcggatcacgaggtcaggggatcaagaccatcctgctgatttacacggtgaaaccccgtctctactaaaaatgcaaaaaattagccgggcgtggtggcgggcgcctgtagtcccagctactcgggaggctgaggcaggagtatggcgtgaacccgggaggcgcagcttgcagtgagccgagatcgcgccactgcactccagcctgggcgacagagtgagactccgtctcaaaaaaaaaaaaaaatctccttcccacttttgttctccattgaaccagttcccaacactagctgctccttgccatgcacacacacacacacacacacacacacacacacagagctaactactattgttagtttcttgtgtttctccagtttttatgtgcataaaatataaacatagattcttttcccccatgctcttacacaagaatagcataatactgttctgccctttcttttttcatttaatatttcagtgcgttacacttgccttattctttttatttaattaattaatttattttctgtagggacagggagtcttgctatgtggcccaggctggtctccaactcttggtctcaagagatcctcccgccttggcctcccaaagtgctgagactataggtgtgtaccattgtacccagcctgattctctctctctctctttttttttttcctgttcttttcttttgagagggggcagggtctcactttgttacccaggctggagtgcagtggcacaatctcggctcactgcaacctttgcctctcagattcaagtgattctcctgcctcacctaccctagtagctgagattacaggcgtgtgccaccacccctggctaatttttgtttttttggtagagaagcggttttgtcatgttgaccagcctcgtctcgaactcctagcctcaagtgattcacctgccttagcctctcaaaatgctggggttacaggtgtgagccactgtgcccactgattctttttaatagccacataatattcagttttatgaataaactataattagtttattcttctaacagaaatttggttgtttctaatctttctaccttaacacagtgttgcaatatatatacattattttgcacatgggcaggtgtgtctgtaggattaatgactagaaatggactttctgggtcaaaaggtatgtctttgtaatgatgatagagaccttgctcccaagggtgctgtaccagtttacatgctcaccagcaacatgggagggtgcttgatctttgccagcacaacagagtgagcgtcacatagtttcacttgcatttcttcttctgtgataattcaagcatcttttaatatatgtaagagccgtttgtatttttttggtcatttcctttgccattttccactgggtgtgtacttttctatttctagaaagaatatgctttatgtattaggaagatacagccctttctatatgagttgacatttttcctggcttgtcatttgtgttttgactttgtttgtggtactttttgtccctggactttaatcatttaaaaattttttcttatttatgtatttatttgaaacaggatctcattctgtcatccaggctggagtagagtggtgccatcatagcttgctgctgcctcaaacttctgggctcaagtgatcctcctgtctcagcctctggagtagctgggaccacaggtgcatcccaccatacccggctatgtccctggactttaagcttcttggctatctacgctccgtcttatctattcccttgaactccccctatctccatttcatctgctcactcattgtcttcatcttttcaggctgctatatcaaaataccataagctgggtggattttaaacaacagaggtttatttttcactgttctgaatgcagggaagtccaagatcaaagcactggcagattcagtgtctggtgacggcttgatttctggttcatggatgatatcttctcgctgtgtcctcacatggttgaggaggggaaggcagctctctggggcctcttttatatgtggcactaatcccatttttgtgggttccaccctcatgacctaaacccttcccaaggccgcacttcctaataccaccccattggtgattaagtttcaatatatgaatttggtaggggagacataaacattcagattttagcatttctcccctggctccccaaaagtcatgtccttcttgcatgcaaaatatattcattccatcccaatagcccccaaagtcttaaaccataatatcagcccacgcttgtaatcccagcagtttgggaggcaaaggtgggtgaatcatttgaggtcaggagttcaaggccagcctgaccaacatggtccaaccccgtctctataaaaatacaaaaaaattagctgggcatggtggcacaggcctgtaatctcagctactcaggaggctgaggtgaaaggatcgcttgaacccgggaggtagaggttgcagtgagccaagatcacgccactccactgcagcctggactacagagcgagactccatctcaaaacataaaataaaataaagataagatacaggtgagactcaagatacgattcatcctgaagcaaactgctctctagccgtgaacctgtgaactaccaaaatacatcaatgggatgggcataggacagacattcccattccgaaaaggagaagtaggaaggaggaaaggggtgacagatctgaagcaagtccaaaaccttacgtctcaggaacaatctttgactcaaggctctgccctccaggcccactgggggctgtgccctgacttccggacccactgggatggaggtcctgcctccacagtttggctgggcagcagtttgacccccaaggctctgagtgttctgttcccacggctttgctgagtgcagcctatgccacagttctcatggattggagtaatgtgcctgtggctgtcccagcctggcatcacgctctggtggtgcaaccagtctggagtctcagggtggccccacctctgcaggcaccccacccccatggctccactcggcactgcccttgtgggggctctccacagaggccctgctgctgccttgcttctctgcctaggccctgaggccttctgggggcatccttagaaacttaggtggaggcagccacgtccccacagctttgctgggcacagtacaccccaaaccagggcccactggagcggcatctgggatggccgaggaggtagaaatggagtgtggggagcagagtcgagaggcagtggtagccaaagtcccacaggccctggtggcccctcctttgaaattgctctgtcctctgggccctggcacaatgggcctatcacgggaggagcagctccagtcatctctgaaatgtctttggggtccttcttttttttttttctagatggagtctcgttctattgcccaggctggagtgcagtggcacaattgtggctcactgcaacctccacctcccaggttcaagagattctcctgcctcagcctccggagtagctgggattacaggcacgcaccaccacgcctggctaatttttgtatttttagtagagacggggtttcaccatgatggtcagactggtttcaaactcctgacctcaagtgatctgcccacctcagcctcctaaagtgctaggattacaggcgtgagccatggcacccggccttggggtccttctttcattctcttggacaacagatcctggtttctgttgagatggctgatccatactaatctccttatcaaatgtttccttggccacacctttgttctctcactctctttctctctctttctttttttttttgagagagggtcttgctgtgttgtccagactggagtgcagtggtgtgtttatggctctctacagccttgacttcccaagctcaagtgatcctcccacctcagcccctcaagtagctaggactataggcacatgccagcctgctatttttttttatttgttttagaaacagggtattgctatattgcccagacttgcctcaaactccctgccacaagctatcctccttccttggcctcccaaagtgtgggattatagccctgtgctgccacacccagctgttctgtcttatataggctttctgtttttttccaatatgggtaggctttgagttctacctttttgattaacaattccatttttttttttttttttttttggtgagatagaatctcgctctgttgcccaggctggagtgcagtggcacaatcttggctcactacaacctccgcctcccaggttcaagcaattctcctgcctcagtctcccaagtagctgggattacaggtgcctgccaccacgcccagctaatgttttgtatttttagtacagacagggttttgcaatattggccaggctggtttccaactcctgacctcaggtgatccacttgcctcagcctcccaaagtgctgggattacaggcgtgagccaccggtgcctggccaacaattccatctttaagtcatttctctctcacttcattttactataagtagtcaagagaacccaggctgcaccctcaactctttacttagaaatagcttcaggccaggcacggtggctcacgcctatagtcacttgaagtcaggagtttgagaccagcctggccaacatggcgaaatttcatctctactagaaatacaaaaattatttgggcacaatggcacacgcctgtaatcccagctacaagggaggctgaggcatgagaatagcttgaacccaggaggcaggggttgcagtgagcaaagattgtgcaactgcactccagcttgggtgacagagccagactccaacttgaaaaataaaataaaaagaaatggcttaagctacatgtctacttttgttgctcacaagttcttccacaaaatagtgggtcataaacacaattcaggcaagttctttgccactttataacaagaattgcctttcctcccgttttgagtaacatattcctcatttctctctgagacctcatcaaaatgacctttcttatccatattttcaccaacattctatttatgaccacttaggtcttctttgagaagatcggggttctcgctacagctcttttctccctccctccctcccatcctcctttccttccttccttccctccctccctctctccctctctccctgtctctctctctgtctctctttctctctttctttcttcagagtttcactctatcgcccaggctggagtgcagtggcatgatcttagctcactgcaaactctgcctcccacactcaaactatcctctcgcctcagcctcctgagtagctgggactgtgggtgcacaccaacacgcctggctaatttttgtattttttgtagtaacagagtttcaccatgttgcccaggctggtcctaaactcctgggctcaagtgatctgcctgccttggcctcccaaggtgctgggattacaggcatgagccaccactcccagccccatacatgttctttctttgttcaaaatccttccagccagacgtggtggctcacacctataatcccagctctttgagaggccgaggccagaggatcacttgaggctaggagttcgagaccagtgtgggtaatgtagcaagaccctgtctctacaaaaaattaaaaaaattaaaattaaaaaacataagaagcaaataaactcttccatagctccccattgccctcaggaaaaaatccaaaccgcctgacacgcctcccagcccctgcataaagcaggtctgcccacctctcccactcttcctctgccattttccgctcagtttctttcttacgaacaccaccacactggtttcctttgagtccctgaatgaggcacgcttgctcacgctgtgtgttacatctttccctcccctcaccttcccactctcttagactaactatacctacacacactcctgggatcagctcagacctcacctccagggagcttccctggaggaggccgcagctccagcaagggagcaaaggagcagggagggggccagcttggcaggagtgggatgagacagtggaaggatgagatcggagggcacggcagagcaagtgatcatggaaggccttgtcaatggatcacagtgagacttcggcttttcatgctgagtgaggtggaagccacaggaagattttcagcagagaaacagggtctgattcaggattcttctggcatctgagaagcggctgggaagaagcaggaagaccccaacactctcaatcagaattaatctccacttagtctgtgtacccagggcacatgaatatactgctttaaacaagcaaacgccttggtttcttctgtctaatgttttagtttcctgtacgcagcaggtgctgaagcatagtgattaagactgagggctatgcagcccagcctttctgaactccttccacaggtctgtcgcaaggattaaatgaattaatctgcataaagggtgcccagagcactgtcagtgctcaaggaatattagccattattaggaagtgtctgtctgcactgctataacatgacttttttttttttttgagacagagtttcactcttgttgcccaggctgttgctcaggagtgcaatggcacgatctcggctcactgcaacctccgcctcccgggttcaaacgattcttctgtctcagcctgccgagtaggtgggattacaggcatgtgccaccatgcccagctaattttgtatttttagtagagatggggtttctccacgttggttaggctggtctcgaactcctgacctcaggtgatccaccctcctcggcctcccaaagtgctgggattacagttgtgagccaccacgccccatgactttctaaggaatgctgtattgctttaagccaggttcacggaagcagccctcaggcagtttgctggagatcgaagcctctgctggctgcctaggtctcttcctcctgctccttcttctcctctttccctctggattgttggattcttgcaacaggttcctgcagaatcttgccattttaacacttccaaagaatgccaatgatccgtgggtttcctggacaggtagagaaactcacagaagcatccagccgcaggacgacagggctgatggccttggagcctttgtctaatgcatattgcagataaagaaacgggggcccagaaaggttaagccacttggcatcaggcacacaaggcaagagcagaactgggtaggaattcaggtttcctctctccagtcctggggtatgtttttttccttttatgtacttttttttctcttttttctttttctaaagacagtcttactctgttgcccaggctggagtgaggtggctccatctcagctcactgcaaccttcgcctcccaggttcaaataagtctcctgcctcagcctcctgagtagctgggaatacaggcatgtgccaccacaactggctaatttttatatttttagtagagacagagttttgccatgttggccaggctggtctcaaactcctgacctcaagtgatccctctgcctcagcctcccaaagtgctgggattataggcatgagccaccgcagctggcactccttttatatagttttaaaagtacataaggagtaaaagtatgcaaggtaaggagggccaggcgcagtggctcatgcctgtaatcccagtactttgggaggccaaggtgggtagatcacgagatcaggagttcgagaccatcctggccaatatggtgaaacctcatctctaccaaaaataaaaaacaaaattagccgggtgtggtggcacacgcctgtattcccagctattcaggcagctgaggcagaagaatcacttgaacctgggatcacaccctgggatcggcagtgagccgagatcgcaccactgcattccagcctgggtaacagagcaagactccgtctcaaaaaaagaaaaaaaaaaaaagtaaggaggtctcatctttaaaaaaaatgcacgtaagtgaaaaaaattgtctttaatgatcaccctgtgccatctgccaacattctctatccatatccgctgctctgtttttttttttttttttgccaaagcacttatttccacttgatatatcagccactggaatgggaacacccagaaggcatggatatatgcagagtgtggtctcagtgctaaggacagtgcctggcacagagtaaatgttcaataaatatgtgtttaaaagaataaataatacagccagtcatggtggctcatgcctgtaatcccagcactttgggaggctgaggtgggaggattgcttgagctgaagagtttgagaacagcctgggtaacatagcaagaccctgtctctatctcaaaaataaataaataaataaagccctgcaatccttgttcctcccctatgccaacataattgctgttatcaatttggctttgctattcttctagaccagtaccatccaatagaaggctctgcagcgatgcatagatcctatatctgcactgtttaatccacccaccactagctgcgctggaaatgggcctgatgccattgaggaactaaactttacattttatttagttgtaattcatttgcatttaaatgtaaacagccacacgtggctggtgacaagcatatcaactgttctagacattttttttctgggcatttgcatatgtatatgtcatcaggggctattttgcgtttttgttttacgtacattttcatgctccatgtagccttctgctacttacttttttgcattgagcaacactacattttggaaggcttttcatatcaggccatatagatctgcctcattctttttacttgctgcacagaagtgcatagtatagatgtgccataatttgtttagccattctctatcgggagacatttacttatttacttacttacttttctcttttttcgaaaaatagagatttgttgtgggggagggcggggttttgctatttttgcccaggctggtctcgaactcttggcctcaagtaattctcttgccttggcctcccaaagcggtgggattacagatgtgagccaccacaactggccaatattattattattattgatttttttttttttttagagatagagtctcgtggccgggcatggtagctcgcgcctgtaatcccagcactttgggaggccaaggtgggcagatcacttgaggtcaggagtttgagaccagcctggccaacatggcaaaactccgtctctactaaaaatacaaaaattagccaggtgtggtggcgcctgtaatctcagctactcgggaggctgaggcaggagaatcgcttgaatctgggaggcagaggttgcagtgagctgagatcgtgccattgcactctagcctaggcaacagaatgagactccatgtcaaaaaaagaaaaacaaaggctgggcgtggtggctcacgcctgtaatcccagcactttcagaggccgaggtgggcagatcacctgaggtcaggagtttgagaccagcctggctaacatggtgaaacgctgtttctactaaaaatacaaaaaattagctgggcgtggtggcacacgcctgtagtcccagctactcgagaggctaaggcaggagaatcgcttgaaccctggaggcggaggttgcagtgagccgagatcacaccattgcactccagcttgggcaacaagagcgaaattccatctcaaaaacaaaaaacaaaaacaagagacatagggtctcactctgtcacagactggagtacagtggcttgaaaatagctcactgtaatcttgaattcctggactcaagggatcctcccacctcagcctcctgagtaactaggactacaggtacacagcactgtgctggttgatttttaaattttttgtagagatggagtctcactatgttgcccaagctcgtcctgaacacctggcctcaagggtcatttagatggttttcaatttgtctctattaaaaatagacctgcaacaaatgttactgttcataccttcttgggcacgtgcatgaccttttctctctgatgagtacgaataacaatagttctttatttctttctttctctttctctctctctctctctcttttctttttttgacagagtctcattctgacacccagactggagtgcaatggcgcgatctcggctcactgcaacctccacttcccaagttcaagcaattctcctgcctcagcctcccaagtaaatgggatttcaggcgcctgccaccatacccagctaatttttttgtatttttagtagagacagggtttcgccacgttggccaagctggtttcaaactcttgaccttaggtaatccacctgcctcagcctcccaaagtgctgggattacaggcatgagccaccgtgcccgacttttttttttttttttttcagcatcttgctctgtcacccagatgggagttcagtggcgcgatctctgcccactgcaacctccttttcctgggttcaagcaattatcctgcctcaggcttccaagtagttgagattacgagcatacaccaccatactcagctaatatttgtatttttattagtgacggggtttcaccatgtttgtgaacaggctggtctcgaattcctgacctcaagtgatctgcttgccttggcctcccaaagtgctgggattacaggtgtgagccaccactcctggcccaataacaatagttcttattttagtaataataataattgcttctacttactgagcccttattgcctgagccgaagcattgctctaagccctttacttgtattaaatgatgtaattatttttacgagctgggcacaatggctcatgcctgtagtcccagctactagggaggctgaggtgggaagatttcttgagcccagaacttggaggctgcagtgagctataagctatgatcatgccaccatactccagcctgggcaacagaacaagaccttgtctctcttttatttttttctcttttgagacagggtctcactctgtcacccaaactggagtgcagtggggcgatcttggctcactgcaacctctgcctcctgggctcgagggatcctcccaccttagccttccaagtagctgggaccacaggcacacaccatcatgcccagctaatttttgtatttagccatgagcctccatgcccggcaagaccttgtctcttaaaaaaaatttattatgttgaataagagaggttttattattatttccatagtacagatgcagaatctgagcctcagttttagaaatttgcccaaaattacataaccagtaaatgacagagctgagatgtgaactcaaacatccacttcttgagtctgaatatccattttctgttttcctagctcttaccaagctagcctgctgagggactatgctagtgtccacacaggcatgggtccttcacccacagagccgcactgccaccccagggatcactttccaggtttgaggccctgggcccctggatctagggtaagacatgcatccctggagccttggaactgggcagagctgaagtttcggtccatcttggaagcactaaactacagacatgccctgtgtcttgtcccatccccctattattaagtcctgagtcttcctccctggctggtgatgtgctgagagtgataagaagataacagcaagacagacagagtgagagcgacaggctgacttacgtaacctggtggaaagtgatacaggcagattcgctgatgggaaacaaacagaaagggagtcaggcagagcttcctggaatccaggtctaggagctgccaaaaacaggcctcctctcttaggaacaattgaatgtcactgcagtaaccgaacactgctggccagagaggcctcctgcccacagcctcacagagcggcctgtgtgagccaggacaggctccagaggaaaaaagggcctggcaaggtgccctgtgaggctatctgaggagacattgcagttcctcaccctggatgggcctccaccagcacagggctgcgagttgaaggccagggaattcccagggcgagtcccaggcacagaggctgtgagctaggagggctctaacctggggttaagccctgaactcagaagccgggctcctaggctcttatcctagcttttttctgctgtgtgaccctgggcatggcataacctctctgagacctctctctctcagtcttctcattggtagaaagggaataaatatgtgatagtagataaaaataggactcgtagaaaggggataaaaatgttataagaatcaaataagccaggggcttgacaaaccttttaggtaaatagccatataatatagattttaggctttgtcggcagtacagtctctgccacaactattcaactctgctgttgtacagcacacaaaaacaacaacaacaaaaaaccaaatgactatgcccacgtgccaataaaactttatttctgggtactgaaacttgaattttacataattttcatgtgtcacaaaatattctttttttttttaaatttgtatttatttacttgtttttatttatttgtttatttgagatagagtctcgctctgttgcctaggctggagtgcagtggcacattcttggttcactgcaacctctgcttcctgggttcaagtgattcttctgcctcagcctccccagtagctgggattacaggtgtgcaccgccatgcccggctaatttttatatttttaatagagacagggtctcgctatgttagccaggcgggtctcgaactcctggtctcaagtgatctgctcacctcagcctcccagagggttgggattacaggtgtgagccactgcgcctggcctccagccatcatattttatctaatgttccattcggagacatgtagattgtctctagtttttctttctttcttttttttcttcttttttttttttttttttttttttttgagacggagtctccctctgtcgcccaggctggagtgcagtggcgccatctcagctcactgcaagctccacctcccgggttcacgccattctcctgcctcagcctcccgagtagctgggactacaggtgcccgccaccacacccagctaatttttttgtgtgtgtttttagtagagatggggtttcaccatgttagctaggatggtctcaatctcctgacctcgtgatccacctgcctcggcctcccaaagtgctgggattacaggcgtgagccactgcgcccggccctagttttgcatgctcagggctgtgaaacacatcctcagctattcttgtctgcttgtttcttaaacacctagacctggaatttgcagggggaaaagcataaacctggggcctccaatgcatgttacttaggcaggtggttgtgcattggattgctcttgttcctgggcaggacagatagtggctaaaagccaggctttgaagtcctgtagagcagagttcaaatcccagctcagtatttactggctgggtaatctttggcaggtcacttcaccagtttgagcctccatttcctcatttgtaaaatcctgccttcattggtcctcatctcacttctgactctaaaccaccatatcccaagatggggctgattagaatgacttcctcatggaagttacaattattgaaattgtaatcgcttgatgaatggaagttcccacttcttttatcccaggcagtttctcaaaagcaaaaggaaaaggaactaaggccaaaatctgggaacctacaaaatcactgggaatgaaacagaagtgtgggcattagaatggaggctcaatatcccagtccaagatctatggatctggtggaaaataacccactaaaactggctccaactataataaaagggggaggctgggctcggtggttcagcctgtgatcctagcactttgggaggccaaggcgtgcaggttgcttgagcccaggagtttgagaccagtctgggcaacatggcgaaaccctgtctctacaaaaatacaaaaaattagctgggtgtggtggtgagtgcctgtagtcctagctactgggaggctgaggtgggaggatcacctgagcccagggagtttgaggcttcagtgagccatgattgtgccactgttctctgttctccagcctgggtaacagaatgagaccctgtctcaaaaaaaaaaaaaaaaaaaaaaaaaaagaggaaaaaagaaagaaaaaaaaggggaaattcaccataagaagtatcagtcaggagtgtttctgctgttgcagaaacccaactaaatttggttgaagcatgaggagaatcaacttttatttttggtcacttaattgaaaacatcaggacaagtgccagcttccagcacagctggacccaagggccaacatgtggctccagggactctccctccgtttccagtgctgcactccagcttttgctgtgtccccactcctgggtcaagatggcctctcagcaaccgcagagccaggcaattctgtcttttcacggatgagaacagaaagtcccagaaggaagtctcactgggtctagcctggtcacatgcccatttctaaaccaatcgctgtgactgggccagcctagagctaggcagagctggcccccacggacagaaaggaggagacccgtagctcccgggagaatgcaggtgctgtttccagaaggggcatcaaggccagaaaggcaaagacaacaggtgtctattatgccacctggctgtactttttgtgagaaccgctgttatcacatgaaacacaagggcaggaagtgcagtggcctcacacatttcttaaatgagcacctgaaaggccaccaggaattgtggcagccaaatcctggtctctctatgactctgcccacaggtttcctcatctctgcttctctcttttccctctccctgtcttcttccctgagcccatgagcaaacccgactgccccatagcacctgacagcacaaccccttcctttaagcaacagcccacaagactcaccacattctcaagacagagaatctgatcacctcaaccagtcaggtgcccgtctttgtgcagtcaattctggctggagggcagggttgagtagcttgtacgcgtggtttcatggggtagttgcacctgtttcaaagagagatgggtcaccacaaactgggcagaaaccacacgatatgtccatgatgctctgcagctgaatgaagttatctacaaagaaactgaagccaaggccaggcagaagtcaggcctgaagctaagaatttgtttccccaagacaggaacattcctgcatctggaggctgaggctgcttggacagagaagtgcatccagctgccaaggtgaagctctgaaggggcctgtccatgagagcagggccaagaacgcctaagcccaccagtaagatgcaagaacacctgtgcgaaataataataatgatcatagctgggtgtggtgcctgacagctgtaatcccagcactcagggagacagaggcaggaggatcacttgagcccaggagtttgagaccagcctgggcaacctggcaaccccttccccacaccccttgtctccacaaaaacgacaaaaaatttttaaaatgataataatataaaatagcactaataataaatgttattcagtgctgctgaccaggtatcactctagacacttaaatgaacagcatttttgcttttttgtttctttgtttttgagacagagcctcactctgtcccccaggctggagtgcagtggcaccatcttggcttattgcaaactctgtctcctgggttcaagtgattttcatgtctcagcctccggagcagctgggattacaagcgtgtgccaccacgcccagctaattttttgtatttttagtggagacgggggtttcaccatgttggtcaggctggtctcaaacttctggcctcaaagtgatccacccgtctcagcctcccgaagtgctgggattacaggcgttagccactgtgcctgacctaaatgcgcagcatttttaagcctaatgatacagtcagatgggtatttattatcctcatttacagaacatatattgaatgagtgagcattaactgatctttcaccttattaattcacttagtcattcactcactcaatggataaacaattaatgaatgccaactatatgccaaataccatgtgtgctgggtgttgggacacaagcagtcctgtctttgtgaatgttacagtaaaatgttggaggctctgaagggtgagtggtcattaattagacggttagactaataagaggggaagggaaaggcattccaggtagaaggaactccatgtgctaaggcactgtgggggaagggcatgtgtggggtgggagcaatgcctgttgactgatggtgtgccagagaggcagagagccacgcagtttacacctgctggctcactgacccttaccacagtcctgtgagatagctactgctattaatatcattttgtagatgaggaaatcgaggcacagagaaggtaagtaactttcccaaggacacacagcaccattagcagtgaaagagcagcagttataacccaggcctgtgaccagaattctgaacatctctaatctttaagtaaaggaaggcaggagaaattggtccatttggggcaggtgtgttttctgggaaccttccagcactattttcacttgcagctgtagccacaggctacatagatgatttccagaatggaggggaagaagagtgcacccagcctttcctggccacaggcaggaatccttttagccagttattaatgctcagccacaggagatgccgcagtgagacacacagaggagccagaccagggagaggcagcaagaaagacagcattgatcctggaggtatacatttaggagagagaacctgtcagaacagaaagagcttggacttgggaccaggccaacctcagcccaaatggcagccctgctacccaccagctctgtgaccttaagtaagtttcctcttagtctccagttctttattcaagcagagtaaaagtatgcttcccgcctccctcccacctccatcctgtagccaacagtcccccctccccagaggcaggcactatgactagtttcatgcatcatcttccgggtaaattgtagagagatagatggatgaatagaagtatatatgtgtgtgtataatatagtacacacatatatgcaaatattgtaactattgggatgctttgactaagtacaaaaaaacctacagatgcaagatttacttattaagaactgtggagataataaatgcctaatttctgtgtccaactgctcattaatgtctagtaagaatctcaaatttaacatggttaagattaaacttttattgttattattattattttgagacagagcctcactccgctgccctggagtgcagtggtgcaatcttggcttactgcagcatcaacttcccaggctcaagcaatcctcccacctcagcctcctgggactgcaggtgcacaccaccacgcctgtctaataaaattaaactttatgattcctcaccctccaaacctgtttctcccttactaaatacctggttactcaagccaaaaatacactgaaataattctggatttttctctctttcactcactttttttggggggtgctggggtgcagtggcgccacctcagctcactgaaacctccacctcctgggttcaaggagattcttgcgcaccagccactggagtagctgattacaagtgtgtgccaccatgcccaggttttttttttttggttttttttttttttggtatttttagtagagacagggtttcgccatgttggccaggctggtctcgaactcctcacctgaagtcatccacttgccttggcctaccaaagtgctaggattacaggcatgagccaccacgcctggcctttcactcactttttacatctgattcatcacatagtcctgtccagcttttctgaaaatctagagatagatccaccattaagtgaatgaagcaaagctgagatcagggctcttcaattgcacagccccttccaaatctagcaatatgttcacacagtcatgtgtttctgcaacatctgcaaaggtaagtattttagctgcaactggttagacaaggtctctccagctccccaacgttgcctgcctgggaatgtgcatcgggtggcatttggggagctatgggcagggatcagctaaggggaagatgagttagggaatccattaaatttgggtttagtggatgtaatcttttttttgttttttaatagaggtgggggtctcactgtgttgcccaggctagacttgggctcctgggctcgagtgatcctcccacctcaggctcctgagtagctgggactacaggtgtgcaccactgcacgcagctttagcgggatgtagtcttgtagctcacgatcttttcggtgaataaggaaagtattgcttgttgtcctggcagagaaatggcttccaggatactccttctgcccatgctactgactcacccagtatcaagacacaaaagtctggcacggtggctcatacctgtaatttcagcactttgggaggccaaggcaggaagattgattgagcctaggagttccagactagtctgggcaacatagtgaaaccctatctcttcaaaaaaaaaaaaattgttttagctagcctggagtggtggtggtgtgttcctgtagtcccagctattagggaggctgaggtgggaggatcacttgagcccaggaggtcaagactacagtgagccatgattgcaccactgcactccatcctgggcaacagagaagccctgtctcaaattaaaaaataaaaataaaaaaacaggcacaaaagtgactgggcacagtggctcacgcctgtaatcccagcactttgggaggccgaggcgggcagatcacgaggtcaggagatcgagaccatcctggctaacatggtgaaaccctgtctctactaaaaatacaaaaaaattatctgggcgtggtggcgggtgcctgtagtcccagctactcgggaggctgaggcaggagaatgacgtgaacccgggaggcggagcttgcagtgagccgagatcgtgccactgcactccagcctgggcagcacagcaagactccatctcaaaaaaaaaaaaaaaaaaaagacacaaagttatagtactaaggatgccagagcaggaagagagaaggaatctgaatccttagtgatagcattgcttccctaaatgaaccaactgtgaaactgttctacatccagactcctcataggtaaattatacatttgcgggttgggtattgttttatatttgcagccaaaagcatcccaacagatacaacaatatatgcttccatgcctctaaagttaacctggaaggagatatacaagactggtaatgctgaatgcctctgtggagggggacaggtagcagaggggaatgggagggagacctatttaattcagatttttttgtgtgtgcttgaattttgtttctctggggccaactttcaccatttcaaaaagtagatagtaaaacttcaaagtatgtggaacacttgggaacttttttttttctttgggacagaatcttgctctgttgcccaggctggagtacagtggcacagtctcggctcactgcaatcttcttgtcccaggttcaagtgattcttgtgcctcagccttccaaatagctgagattacaggcatgcaccaccacgactgattaatttttcgtaattttagtagagatgtgatttcgccatgttgccaggcttgtctcaacctcttaagctctggtgatccatccgcctcagccttccaaagtgctgggattacaggtgtgagccacggtgcccagccaggtttttcatttcttttaagcgcatgaaagaagtacatttaatctggcaaggctggctcttgctgaagtggtctcggagaggccattggaacaacaaagaaagaaatgtcattggcaagttcagatactaaagggttggaaagtgatctggcactcagcatcctgcagcttgagggacatttggagttcttcctgcctgcttcccactgctgagcaattcccagcccagcctgatatttcaaatgatttccaggaaggggaacctggcaccagctgtacccccttgaagttcttgtgactgtcttcttcaaatgcatccgcctgcttcttcttcaaaagacaagagaaaatgctgctggcgagctaagagacttcaaagatggttttgtcatgtgttttttgagtcaagaggctaagtttctgagaggaggagagatttttttcaaggacacatacagttaattggtgacaggactccagtgtccacttagctaggctccttcttgctcctgttctgcccagggtccttagttcttccaggctgttccacccagtaggcctcccaggttctcaaagtgatagcacagggagatctcctggggaaaaaaatgaccttgacatccatggtctgtgagtctggggaaggctgcattctatagcagcctcctggagatttacagagcatgttggcagattaagggttctgcagagtcctgcataaagaaaactacttaaaaaaaaattcctggccaggcacggtggctcacgcctgtaatcccagcacgttgggaggctgaggcgggtggatcacttgagatcaggagttcaagaccagactggccaacatggtgaaaccccatctctactaaaaatacaaaaaattagccgggcgtggtgatgcgtgcctgtaatcccagtgactcgggaggctgaggcaggagaatcacttgaacccaggaggcagaagtggcagtgagccgagatcacacaactgcactccagcctggtcttgctgtgtcacaaaaacagagtcttgctctgtcccaaaaacaaaaacaaaaacaaattcctcccaggtcaggatatcaatagtactcacctcgtagtgttgtcatgaagattagtatcacgaggctacaaccatttatcggatatcagagtttcaaaatttacactaaatgggttcaataagattatgtataacctcaggacaggtcaggatttccttccaaatgagtgctggcatcagacttttgagaaacagttcatttcatagccttttttgttttgttttgtttttcagagatgtttctagttgtcattatgggctttttttttttttttctgatgcctgtcttcctcctgcagtatgatagccttttttgattttagaattgtggttaaaggaatgaggacttgtaatgaagataatagctaatatttattgagcatttttgtgaaacccggcaatgttccaagtgcctcacatcaatgaacttattgaatccacagagcaactgcacgtgacagatagtgtggtaaaccctgtcgggcaaatgagcaaactgaggcgtagggggactaagtaacgcactcaagcagcagagctgggagtaaatgagacaatatgtatgaattgtttatcacaatgcctagcacataatcaacaatccatataaacattagctattatcctcattaatgatgggagaatcatgactaatcttttttattttttgtttttcagacaggatcttgctctgtcaccaggctggagtacagtggtgcaatcatggctcactgcagcctcaatctcttgggctcaagcaatcctcctagctcagtccccaagcagctaggacaggtgtgtgccaccacactcagctaagtttaaaaatctttgtagagatgaggttttgccatgttgcccagactggtcttgaactcctaggttcaagcaatcctcccgcctcagcctcccaaagtattgggattacaggcgtgagccaccacgtctggccttgactaacttttatcttctttgcacccatgtagaatttctaattttactataataaaaatattctgggctgtgtgtggtaactcatgcctgtaatcccggcactttggaaggccaaggtgggcggatcacttgaggtcaggagttcaagaccaggctggccaacttagcaaaaccccatctctactaaaaatacaaaaattagccaggcatggtggcacatgcctgtagtcctagctacttgggaggctgaggcatggggaggcagaggttgcaatgagctgagatcatgccactgtactcctgtgatggagtgagactctgtctaaaaaaaaaaaaaaaaaaaaaaaattatatgtgggggaaaatgtttttcaaaagattagacaatttctgaattgagcctaatatctcaatatctctcagtctctcttctcactccatcaggtctgatgctggtctgggcagaaatggatttgtcacctcaaagatgacttccttgggcacaactaggccagacgctgggtaccttgtggtggccctggaggggtacagcttcaagaaagaacttgccgatcccctgcaaagaatgcagttagccaacagccttcggcctcagcacatttgagatctgccttaactttcaagccaaggctagctcttcctgagcaggctccagcgaagaacctgcatggagggactaggacccgaccagttctgcccaacatggggctcccctaacaaacagtctttgttctggagctcccaaactgagttgacaaagcctctgtcagccctgcattgccgtctgaggctcccctgctgagtgctgctttcacccacttttgtctttcacaggcatgacactcctccctctcgtcctactagctccactttaccatctgcttcccagaggactggaactgacatgctgcctttactaccccgcaaccattctcaccccacctccacatatgcctgcccaaataatcttgattttgggctcagctactagatcgaaatcccttcatctttggagagtgggttgctccccagccccagcagataaatcatgatctgtcttaagtagacccagtaagtcctttctgttctacaggaattggtccaggatgggtgcctggtccgccttttagccaatgagaggtcaggggaaatctggggcttcactttactaataacatagaccttcaggtagttaaagccttctgccctgccccttcccttccattttgatcagtgtcctgtgatcaaatgatgtgaggcactgcagcagctgttttgggcaatgagtttgaggacaaaagccaactgctgaagatgacagagcagaaagatgagaagagcctgagtcctgaagaacacccccgagcccctgcaatgactctggagctgctgacctccacatgttttgctataaaaaaaaagattgcatttcttctttgctcaagccaccatgaatcaggcatgctgtgactggccgctgaaaatatggtaacgcatgcagtcacattccccatgttctattctccagattaccttcaaacaactgaaggtacaggactcagagttcccgttgaggtatttgaactattttcctggaagggaaatattcaaaaagtcctctcagccccgggcacagtggcttacactgtggattacaaaaggacttttaaggactcataggattacaaaatcctgtaatcccagcactttggtgggcaggtcacctgagatcaggagttcaagaccagcctggccaaaatggtgaaatcccgtctgtactaaaattataaaaattaccgagtgtggaggtgcatgcctgtaattccagctactggggaggctgaggcaggagaatcacttgaacccgggaggccgaggttgcagtgagctgagatcacaccattgcactctagcctgggcaacagagtgagactgcatctaaaaaaaaaaaccaaaaaaattatctcatttccaacttgccaacacctgtgataatgtaaaccaaaaatgaaattctaagcccctcaactgactgaatgaatccccatcttcaccaaggtgatcccaaagaaaacctgaaaaactagttcaggccatgatgggaaggaaggtcagatatgcctcttcgcctcttcatactttcctccctttggagtttaggcacaactggtcagcattcatattaaaatacagatcatcatagggcgggcatggtggctcacgcctgtaatcccagcactttgggaggccgaggcaggcagatcacttgaagtcaggagtttgagaccagcctggccaacatggtgaaaccccgtctctaccaaaaatacaaaaattagccaggcatggtggcaggcgcctgtaatcccagctacttgggaggctgaggcaggagaattgcttgaacctgggaggtggaggttgcagtgagctgagttcgctccactgcaatccagcctgggtgacagagcgagactccatctcaaaaaacaaaacaaaacacaaaaaaccagatcatcagatggacaaaacagactctttgtgcaataagataccaaattccaacctgaccctgtatgtgatgtagagcataacagtgacagataacaggccctaaggaaagtcaaagtattttaccccaagatatatttatttgacatattttggagtgaccctgcaaagcccactctttgccttctgtagcgaatccccttcctgttccaggtcttttcctgatccaggagagaattaaactaagagtctaacaccttttgaggtctaataagagaaatctaccatctatcctgtctgaagctgggtgcttagaggcttcatctacataaacaagaaccttggcttccacaactctcttaccttaactcaagcatttctttttctttcttttttttttttttgagttgggttctcaccctgtcacctaggctggagtgcagtggtgtgatctcagctcactgaaacctctgcctcccaggttcaagccatcctcctgactccacctcctgatagctgggagcacaggtgcgtaccaccacgctgggctaatttttggtagagtcaggggtctctccatgttgcccagtctggcctgggactcctaggctcaagcgatccacccgtcttggcctcctaaagtgctgggattataggtgtgagccaccgcacctgacctcaaacatttctttatgctgacttcaactcctcaggcaatgcttcactctttcaatcaattgccaataaggaaatcttcgaatccacctatgccctggaagtccctctgcttccatctttgagatgtcctgccttttgaggctgaaccaatgtatacatttcatgtattgctttatgtctttgtttgtgacttccatctctctaaaatgtataaaaccaaactgcaacctgaccaccttgtgcatatgtcctcaggaccccctgaggctgtgtcacgggccatgatcactcatatttgggtcagaataaacttcttcaaatattttacggagtttggcttttttcctcaacaatacttacctctcccttgcttcaaaccctcccatggctccccagtactttttcagttttttttttgagacagagttttgctctttttgtccaggctggagtgtcgtggtgcgatctccgctcactgcaacctctgcctcctgggttcaagtgattctcctacctcagcctcctgagtagctgggattacaggcacccgccaccacatccggctaatttttgtatttttagtagagacggagtttcaccatgttggccaggctagtcttgaactcctgacctcaggtgatccacccgccttggcctcccaaagtgctgggattacaggcgtgagtcactgtgcccggccacccccccagtactcttaagacagagtttgaactcctcactgataaagacctgcaagatctggcacctcctggtcccctgccatcacccatgacccttcctacttcatacttgttccccagccagactgaactacttttaattgcctaatattattactagaaaggggtcctgatccagaccacaagaaagaattctctcacaagaaagaattcgggatgagtccacagagtaaagcaaaagcaagtttactaagaaagtaaaggaataaaggccgggcgcggtggctcatgcctgtaatcccagcactttgggaggttgaggcagggggatcacctgaggttaggagttcaagaccagcctggctaaaatggcgaaaccccatctctactaaaaatacaaaaaattagctgggcctggttgtgcgcccatgtcatcccagctactcaggaggctgaggtatcggaattgcctgaacccaggaggccgaggttgccatgagccaagatcgcaccactgcactccagcctgggcgacagagtgagactccatctcaaaaaaaaaaaaaaaaaagtaagtaaaagaataaaagaatggctattctgtaggcagagcagcagcatgggctgcttgactgagtgtatttatggatacttcctaattatgtgctaaacaaggggtgaatttttcatgagttttccagggcagggttggggagctcctggaagtgagggtttctcttctttttagatcatatagggtagcttctggacattgtcatgactctggtgggagtgtcttttcgcatgctaattagtgtataatgagcagtgaggacaaccagaggtcgattttgttatcatcttggtttggatggcttttgacctgcttctttactacctcttgttttgtcagcagggtctcaatgacctgtatcttgtgataggaatcctgctggcctcttatctcaacctgtgagaaagaatgcctaacctcctgggaatgaagcccgttgggtctcatccacattttacccagcccctattccagatggagtcgctctggttctaacacctctgacaatatcctatattacctccagacatttgcgtatgctaatttctctccctcctcccccatttcatgtggctgtctcctccttcgtcaggtctcaactcaaatgttttctcccccaagaggccttccttgatttcttttctttttttttttttgagatggagtctcgctctatcacccaggctggagtgtagtggtgcgatcttggctcactgcaacctccgtctcctggattcaaacgattcagcctcttgagtagctgagattacaggcacccacaaacatgcccagataatttttgtatttttagttgagacggggtttcaccatgttgtccagctggtctcaacctcctgagctcaagtgatctgcccgccttggcctcccattagtgctgggattacaggcatgagtcaccgcacccaaccaccttccttgatttctagactggattctgaaaccccttagggctcccattgcacctttgtgtttaccctgttgaaacagctatcaaactggattatggttgtctgttttcaggactgctctctgctctctcctatactacctctagctttttttctttttcagatgtagttttgctctgtcacccaggctggagcgcagtggcactatctcggctcactgcaacctccgcctcccagattcaagcaattctcttgcctcagcctcccaagtagctgggactacaggcgcacaccaccatgccggctaacttttgtatttttagtagagactgggtttcaacctgttggccaggctggtctcaaactcttgacctcaggtgacccaaccgcttcagcctcccaaagtgctgggattacaggcgtgagccgctgcgcctgacctctagctcttttttctaactgttggcctgctttccaaaagttggcttaggcccatgactaggttcttggctgtagactcacaaagaactgcttcccagagacctctccaccacctcccttttgcagttttactccagcagttggatgtgcttggtttctcaatctgactggtgactcttctctgatcctctaagtccttttttgagacagtcttgctctttcccctgcaaattccaggtctaggcgtttttctttttctttctttctttctttttttttttttgagaaggagtcttgctctgtcgcccaggctggagtgcagtggtgcggtctgactctctgaaggctccatctcctgggttcaagtgattctcctgcctcagcctctcgagtagctgggattacaggcatgtgccaccatacccagctaattttgtatttttagtcaagatggggtttctccacgttggttagtctggtctcgaactcccaacctcaggtgatccgctcgcctcggcctccgaaagtgctgggattacaggtgtgatccaccgtgcctggcggacttttgttccttttagaagaaaataaaaaaagaatctagaggattggtgaaaaataaaagatgacagtagaactctaggaagtgttttttttttttttttttgagacggagtctcgctctgtctcccaggctggagtgcagtggcgcgatctcggctcaccgcaagctccgcctcccgggttttacgccattctcctgcctcagcctcccaagtagctgggactacaggctaatttttctgtatttttagtagagatggggtttcaccatattagccaggatggtctcgaactcctgaccttgtgatccgcctgcctcggcctcccaaagtgctgggattataggcatgagccaccgcgcccagcagaaaggagttttaatcattacttaatccaacgcttttttgttgttgttgaagagggaaaactgaaacgggaatgtaatttgctcaggatcacatggccaagttgtagaatcaggctgcactctagcctgggtgacagagggggactccatctaaaaaaaaaaaaaaagaaaagaaagaaaaagaaattattaacaatgaaaattaaaacaaataaaaatgttagaggctagactccacagccagcccactctcaccctctgtgttgtaaatgcttgcatgaggcttcaggcaactttcaggctgacaaggaagtttacagcacccagtccatagtgggagtgtcctaatgaatgatgaatgcttatcgtgtgcaacagctttttcttcttcttcttttaaatgacctggtcagcaggaagtagcaagagcttcttaatagaacattgggggagccaactgggagaggctcaaccagcttttgaaccagaataatctccgagaagtcacagccttttttgtttggccctcttttcctgcaggtggattcattagagtactttgagttgcatgtaaggagactgggtcaagagggccttaagtgactagagtacttagtattatctcaggtaacaatacaccaataggtggactgtttcagggttggctatttcagcgtctcagttctggggtattggattagcttgttactggacaggggtcccaatccagaccacaagagagggttcttggatctcgcgcaagaataaattcagggtgagtccgcatagtaaagtgaaagcaagtttattaggaaaataaaggaataaagaatggctactccatagacagagcagtcctcagagtgcctggttgcccatttttatggttatttcttgatcatatgctaaacaaggggtggattattcatgcctctccttttagaccatatagggtaactttctgaggttgccatggcttttgtaaactgtcagggcactggtgggagtatagcagtgaggatgaccagaggtcactctcatcgccttcttggttttggtgggttttggcaggcttctttactgcaatctgttttatcagcaaggtctttatgacctgtatcttgtgctgacctcctgtctcatcctatgacttagaatgcctaagtgcctgagaacatatcccagtaggtctcagccttatttcatacagcccctactcaagacggagttgctctggttcaaatgcctctaagcttctcaaggattcctcatggtctcaaaatggctgctacaacttcaaatgtcacattctagcacagcaatgtccaaaggctggaagaatatgtgtgagagagaaaagaagttgggaggtgggaaagtttctctcttttaatagaaaggaacttccttcccagaaaccctcagcagacctccaccaatgcctcaactgccaggactgcttccaatgcttactccaagactgtcaacaggatttccatggctggctcagaccaatcagaattaatttcctgcacatgacatgttgtgttttgttccaacaaaattaggttctgttggcaggggagaaggggaatgaagtaatcaacagaatctcttttagggctttatttataggtcggtgcaaaagtagttgtggtttttaccacttcttttaaaaaatggcaaaaaacacagttacttttgtactaacctactatttatttattttctgagacagggtctcattctatcacccaggctagagtgcaggggcatgatcacagttcagtgcagcctcgacctcccaggctcaatcgatcctcccaccttagcctgccaagtagctggaactacaggtgccaccacacctggctaatactggtattttctgtagagatggggtttcgacatgttgctcagactggtcaattcctgggctcaagtgatcctccatccttggcctcccaaagtgctgggattacaggcatgagacaccacatgctgccatatggctttgataatttcctgagtgggcaccatggatctctttttgtgatccggaccaaaaagcaacttgaacttcccaggatgctcagatgcccaaagcacctaacatgaggggaagatttatggcctagactagactatactggacaccaatttctttgggaaacctcccctccctcgcttccactccctgcagttcaggtgaggctgtttataccccttggttccaccaagaagcatgtgaccaggcctggacaatcaaagcattgccttcttcaagtgacaatgattggttcagagatgaaccacaacttgagttcgtccaatcagagtgaatgctgcaacttcagcagcatttccaggaagtgacctcctttcccaccacactcatacctggcaggatgcaggcctggagctattggttgccagcttgctatcaagtagatactaagactggagccaactcactgaagagcaaagccaagagatggcgagagactatgtctggtaacctcatttgagttcctgaatccagccaggtctgaagccagtacttttcagttacttacttcagtccttttcagttacttaagccaataaattgctttttgcgtaaaaatcagtttcaaatggggcttctgtcatttacaaataaaagaatcctaggctgggcacagtggctcatgcctgttatcccagcactttgagaggccaaggtgggaggattgtttgagttcaggagtttgagaccagcaacatagcaggaccccatctctatctgaaaaagaaaaaaaagggccgggcgtggtggctcatgcctgtaatcccagcactttgggaggccgaggtgggtggatcacgaggtcacgagatcgagaccagcctgatcaacatggtgaaaccccgtctctactaaaaatagaaaaattagctgggcgtggtggcacatgcctgtaatcccagccactcggaaggctgaggcaggagaattgcttgaacctgggaagcggaggttgcagtgagccgagatcgcgccactgcactccagcctggtgacggagcgagactccatctcaaaaaaaaaaaaaaaaaagaaaaagaaaaaagaagtatacatacaaataaaagaatcccaagtttctcagtgtttggaggaacatgtttgaaagacaaattgaaaacatgtttgaaagacaaattcccaggtgaccgagacacctgtgctgggacctgaacctccacctttggaacaagctcctccgggacccctaatgtatgtagtcctgcctttatagtctgagactctctgacccagactttgggggaaggacggtctcttaattctgcatgggaaacaaaagacacccagtcctttccatcacaaagccccagctaccttcttggcaaagagtagggaaatgcctttcattctttcccaatggccctggaattgagaaaatgaaagacagttgatttcccaatcaggttattccaccacgttgaactttcggtaactgtccttgccccatcgtgttgcgaaagcattcaggttgaacagtgttcaggaagaatactcaagcaaaaactggtttgcagccaaatacagagactgcaaaccccagtggcttcaggggccaggcagggaaagtaaacatgtgaaacaatagggagtagtcctgcctgtggggaacaggggagttctcatgccccagcctaataaatgaaaaaattatttatacaccacagtggaaccggagatgcacctaaagccattgggatgtggtttctctttttcatctcactgctctgtctctgatgtggcttcattctcagaggattgtgggctcacaagccaacatcctgacagtttagaaaccacaggagaaatgtttctctttctcaatcgtttcaacataaatcctggatgaaactgttattggccttgtttgagttcaaatggtcatccctgaaccatccctgtacctaaaagaggtatggtggtgtcattggtcagacctgagtctgacccatcctagaatggggttcaggcccactttaaccatatagactgagactggggaatgggaaaggtttcatgcctttgtttgggctccctcagaagcagactctgagatgaggatttgaggtgcaagtggattatttgggagatgatcccagaaagcaccattaggggattgagggaatgagacagagaagagaagcctgcggaaacaggaagtattatccagcaagttactactgtggacaactggagcacaatcccatcagggaactctggcagccagtgtagagcattgttttagtctattttgtgctgttatgatagaataccacagactgggcaatttaaaacaatagaagtttatttggcccatggttatggaggctggggagtccaagggcatagtgctgtcatctggcaagggccttcatgctgcatcattcatggtggaaggtgaaaacgtaagagaaggtgagggtgaacaagagattgaactcgcagccgcaagccctttcacaactggcattaatccattctcatgagggctccattaggctccactccccagcacatttgaattgcggattaagtttccaatacatgcttttggggggacacattcaaaccatagcaaacatagacctcaatgttatcccatcttagtgctgagggagctggggtattcatctaccaacttctgtcagtcattgtctgacagttgctagcaggagagtttttgcccagaacttccagcatggaagagcatggtccctgctggtctgagaaagtcctcagacaaagagacgaagcttgggccagcgtgcattgaaggttaggacaatggccagggcacctatagcctttgcttcattgtctgaaggaaaattggggtgctatgatcagaagaaggcactgatgttgcacaggtcaaacaaacatgttcattcaaggagtgaatcggttggcccattcatcgtctgagtccattaaccaagcaatggcaaggaagggtatactctgttgctctaaggaactggcatggaagctgcacttggcacttttgttcacatctcataggccaggatgtgatcagatggccatatctacatgtggggaaatgtagcttttgactgtccagccaaatctcagggattatggctaggtgtggtggctcactcttgtaatcccagcactttgagaggctgaggtggaaggattacttgagcctagaggtttgagaccagcctgggcagcaaagtgagactcttgcctttacaaaaaaaaaaaaaaaaagtttaaagtagctgggcatgttggcacatgcctgtagtcccagctacttgagaggctgaggcaaggaaatgcttgggctcaagagttcaaggctgcagtgaactataatagtgccactgcactctggcctgggtgacggagtgagaccctgtctcgaaaaaaaaaaaaaaattacagagattctgctacttaaagaaggggaaggaagggccaaatgttttttcctggcaagactttgtgtctatatttcagaaggaatgccttcccagtggacttcagcctacatctcattttcctgaaccatgtctcactgcctccactggagaaccaagtatttagcttcctggtctctctaatagaagaaggcaaggggaaggggattgggagtgggcagtttgggcaggaagatcaaccatcctgatttgcctgggactaaagatattctggagacatgggattttcagtggtaaaaccaacctccaggatctgcagccacaccctatgtagcttgagaccttaactccagttggagaaatgttatcttctctgtcacctcctcctcctaacaaccttctctctctgttcatcacttcctcttcaactaaaaggtggccaggtcctctgctatgccctacatccacttacactctgtcctcatggttggacctccttggaccccaactctgccctgacttctgggaacttcagtggtgccagagcctctgtccagctctcagcatctcccttacctccaccatcttgtttccggccatcttgcgtccttggagtccagagtttgcaaaggtggaaatggagaagctggagagagaaagcgcttgctggtctcactgaaacagtcaggactcaaactctcagcccaaggctcttcgctctgcacccctcaaaacctttggtgcctgttattcaactagcttgacatttctccagctctgaggtgatacctctctccaagatgcctgcagtcagagggcagggggcgtggcacagagtggggcctcaagaaacactgcaaaatacctctagggcccctttctggctctcaaatgatctcggtacgacttgacctgaccaaacagaaagaattcaggctccctcctcaaacctgttcccctaccacctcctaagcggtaggggtggtttggaccccaataatgacatttttatataacttggagtttattattttttctttttcttttctttttttttttttttttttaagacaagagtctcgctctgtcacccaggctggagtgcagtggtgctatctcggctcaatgaaacctccacctcccaggttcaagcaattcttgtgcctcagcttcctgagtagctgggactacaggcatgcgccaccgggcccggctaatttttgtatttttagtagagacaggattttgccatataatttggagtttcacaacaccagcactatttagattttgggccaaataatccttgagtgggggtgggggtgggggctgtcctgttcactgtaggaggtttaggggcaggcctgacctccacccaccagatgcccagagaaccctcctccccagttatgtcagtgcctccagacattgctaaatgtcccctgggagacaaaaatcactcctgaaccactgatctagacggtcaatattttcttaatataaaaagtggggctgggcgaggtggctcatgcctgtaatcccagcactttgggaggccgaggcaggtggatcacgaggtcaggagatcgagactatcatggctaacacagtgaaaccccgtctctactaaaaatacaaaaaattagccaggcatggtggcgggcgcctgtacttccagctacttgggaggctgaggcaggaaaatggcgtgaaccagggaggcggaggttgcagtgagcagagattgtgccactgcactccagcctgggcgacagagggagactccgtctcaacaacaacaaaagggcggggggagcaacaagcaacttcagaaaacgaagtccctttcaatgagtacccaccttctgtggaaaaacctcaagctcactactcaaatgcagcttggaacaaaggctctggcaaccctgccatccagctggcttctctcagtgagtcacactcagagatttctggcgtcactgccactctccccaccccctctcatgcagaacaatgggtctcactctggctctgaccttcttcacacccagcactttactccattttcctggactgggaaagccctttatgttgtgggcaactttgtttgtgctaagtcaacagaaaatgcttcttggcctctaccctcctgagagcacatggtgcattaataagtttaacccagagtttcccaaccttggcgctactgacattttgggctggctcattctttgcttcgggggctgtcctgtgtgttgtctgatggttagcaacatccctggcctccattcacagatgccaggggcaacaccacacctggttgtaaccaaaactttctccagacattgtcaaatatcctctggggaaaaaaaaatcaccctcggttgagaaccgtcgtcaactcctactaggaaccactgaggttagtaatatttttattattattattattatttatttttttattttttgagacagtcttgctctggtacccaggctggagtgcagtggcactatcttggctcactgcaacttctgcctgccggattcaagcgattctcctgcctcatcctcccgagtagctggaattacagatgtctgccaccacgcccggctaattattttgtatttttagtagagacagggtttcaccatgttgcccaggctggtctcgaaattctgacctcaagtgatccacctgcctcggccttccaaagtgttaggattacaggtgtgagccactgtgtccagccatattattattattttagagatgaggaaatcaggattatggaagtgtgatgacttgttcaggtataaggggcaaagtcaggaattggaatttctcccaagccagtgattttcttttccttttttttttttttttttttttttgagatggagtttcactcttgttgcctaggctggagtgcagtggcatgatcttggctcactgcaacctcggcctcccgggttcaagcaattctcctgcctcagcctcccgagtagctggtattataggtgcctgccaccacacccagctaattttttgtatttttagtagagacggggtatcactgtgttgaccaggctgatctggaactcctgacctcaggtgatgcacctgcctcggcctctcaaagtgctgagattacagacatgagccaccgcgcccggcctaagacagtgattttcaaattcgctaactgataaacgtcactggggcccttgctaacagaggcctggccccatgccagacccactgcatcagaacctttaggaaaggggccaggagttctatattctctacaagattcctttcctgacaacctgcaaacatcaatatttaacagccaatattctctgtttttatagcttttctcacatgagcccccactgtttattttttaccttttgttgttgttgtcgttataaatgagacagagtctcattatgttgcccaggttggtctccaactcctgggctcaagtgatcctctcaccttggcctcccaaagtactgggattataggtgtgagccactatgcctggtcttttaaatttttttcgagttggggtgcactggctattcgtaggagtgatcatggcacactatagccttgaacccctggcctcagccccagaagctgggactacagacacacgctcagggtgtccagcttgccattcccacttcagagaagaaactgaagcacacagagattgtgacttgcccaaagccattcagaaagtgagaataggccgggtgcagtggctcaagactgtaatcccagcagtttgggaggccgaggtcggaggatcacttgagcccaggagttggagaccagcctgggcaacatggcaaaactccatctctacaaaaaatacaaaaattagtcgggtatggtggcactcacctgtagtcccagctacgtgggaggctgaggtgggaggattgcttgagcatgggaggtcatggctgcagtgagcaattattgcaccagtgcattccaacctaggtgacagagggagaccatctcaaaaaaaagaaaaaaaaaaatgaggctgggcacggtggcttaggcctgtaatcctagcactttaggaagctgaggcaggcgattgcccgaggtcaggagtttgagaccagcctggcaaacatggtaaaaccccgtctctactaaaaatacaaaaattagctgggcgcggtggcacatgcctgttaatcccagctactcggggggctgaggcaggagaatcacttgaacctgggaggcagaagttacaatgagccgacattggaccactgcactccagcttgggtgacagggcgagactctgtctccaaaataaaaaagtgagaagaaaaataaataaaatttaaaataacaaaaagtaagaaacagaaacatacacacacacaaaagcaaacaaaagaaaacaagaaaaggaaaaaatgaaacaaactagaaaaaacaaaatgagaagaatgtagactgtcatcatgtgccttggccatccctccaggaagatgtcttggagctgggattcgtggataaacaagataaacaagatgtatacattttcctgtgtgcttgcagctacacacacacacacacacacacttgtgcatgcatttggacacacaaacactggggccagagagaggcccagcctccccttagacacattgttgtccaatgtcccccacccccagttggggttctgtaagtaaaaaagaaggaacaggatgagtattcaacaggcaacctttaggttttccatggacctcacctcatttgatagacagaaaagtttctacagcaagttcattggcaggactaggccttgagcccactccctgggacagcggactccacaccacctgttacaactggagattgagtgtctgccggaagctgtttcctggggaactgcagccagctgctggccacacaggagctctttatcccccaccaactcacctccctgggatctacccaggacctgccttcttgagtaacaggatgtgaccctatgtcaccagggcacttgctgcccattgaaagtcctcatgagtcattctccaaggttccaagggaaaaaaaactcctagataggggcccatcccagaaagaaataaaacactggcccagggccgagactttcagagaaaccagctggcctgcttgtgagtgggaggttgcggggggtcaccttgaaccgaggtctctctggacagaactgttttcttattcaatcattcattcatcatctatttatagacatgacatttattcatggattcagctaatatttattaggaggggcaaaataactctcacttctaacctacacatttttgagttgtttacattcattattacacaagtatgtgctgctttcatttttttaagctttgcttttaattaattaattaatttatttatttagcaatcccaggatggagacagatttaattattttaaaataacaggccaggcgtggtggcacacacttgtaatcccagctactcaggaggctgaggcaggagaatcgcttgaacccaggaggtagaggttgcagtgagccgagatcacgccactgcactccagcctcagccacagcctgtctcaaaaattaaaaagagagagagagagagagagagatgctgctttctgatccagaggacatacatgccccactggcaagacagaagatccccaattcggacagctacctggagaagttgacctctaagctgaaaactcaaggatgaacgttgccaggtgacagggaggaaattaccagaaatggtgctctgggcaaagggaacagcatgtacaaaggtcaggagatcatgcttttttccgaaaatgcaagtgtttgagaccatactgtaggaagtgggagaggaagtgatgagctcagagaaaaagacagaaaggcagagagcccacttaaaggaatggctaattaaccacccccattccactcttcccgcccacctccccaccctcatcccactcctaggaccatgactcagtcatgaggttttcacactctctcactttaagctgggcagtttctgtttctcagccaatgtgtcattcatcagcagatcatgtcatcccccccaatccacagcatggttccagaatatcagctgatcctcgtgaattggaccgcaaatcttccagagttttttttttgtttttttttttttcttttttgagatgaggtcttgctcttgtcacccaggctggagtgcagtggcgcgatctcggctcactgcctccgcctcccgagttcaagcgattctgctgcctcagcctcctgagtagctgggattacaggtgcctgccacctacacccagctaatttttgtagttttagtagagatggggttttgccatgttggccaggctagtctcaaactcctgaccttttgatctgccctcctcagcctcccaaagtgctgggactatagacgtgagccgccacactcggccgcttccagggtcttacaaggcgaaaaaaatcttacattgaaaatcaagggagcattaataaatattatagcactgggtgcatcgcccacagataggcaggcaagttttgttcaactggaggcactttatgactaggtctaaagtcgccatttatctgagattgtcctgtctctagcagctgggtctcatttcatgctcagaggaaacttacgaggaaaatgcttttgctatccccacttcacagaagagaactgaagcctagaatgtaagacactcacctcaaatctcatatacctgatcactttttttgaaacagggtctcaagcagccaccccgactggagtgcagaggctggaacacagttcactgcagccttgacctccctgggatcaggtgatcctcccaccttagcctcccgattagctaggactacaggtatgcaccaccacacctagctaatttctgtattttttcttccaagacggagtcttactaagttgcccaggctgcagtgcagtggtgcaatctcagctcactgcatgagatcgtctgctgggttcaagtgattgtcttgcctcagcctcccaagtagctgggattacaggcatgtgccaccacacccgactaatttttgtatttttaggtatttttaggagagacggggtttcgccatgttgaccaggctggtgtcaaactcctgacttcaggtgatccacacactttggcctcccaaagtgctgggattacaggtgtgagccactgcatccggccgcctggctaatttttaaaaattatttgtagaaatgaggtcctgctatgttgtctaagctggtctctaactcctgggctcaagagatcctctcacctcggcctcccaaaatgctaggagtacaggcgtgagccactgtgcccagtcatggtctttgtttaatctttacaatagagcatccccatttacgatatgggaaaacagaggcccagagagctgaagcaacttgccagagacatagcaaaagtaagggagtgctcctacactgctgacaggaatgtaaagtggggcagccactttagaaaacagggtagtagttcctcaaaagactaaacaagctgggtgcagtgatccaagtgcttgtaatcccagcactttgggaaactgagacgggaggatcacttgaacttgggagttcgagaccagcctgggcaacctcgatagtgagaccccgtctctattgaaaaaagaaaaaaaagtgtaaacatagggttaccatatcatccagcaattttccccctaggtatatgtccaagcattgaaaacatatgtcctcacaaaatttgtacatgaaagttcactgcagtattattcattatagctaaaagtgaaaccaatccaaatgtccaacaactgatagatggatatatatattttagacagagtctccctctgtcactcaggctggagtgcagtggtgcaatctcggctcacggcagcctccacctcccgggttcaatcaattctcctgtctcagcttcccaagtagctggtattacaggtgcccaccaccacacccagctaatttttctatttttagtagagacggggtttcaccacgttgaccagaccagtcttgaactcttgacctcaggtgatccgcctgcctcagcttcccaaagtactgggattacaggtgtgcgccaccacgcccagcctataaatgagtaaataaatgtatgtatccatacaatggagtcttactgagcaataaaaagaaatagaggctgacacttactacaatacagattaactggaaaaacatgttaaacaaaagaactggccgggtgcggtggctcatgcctgtaatcccagcactttgggaggcagaggcgggcaagagttcaagaccagcatgggcgacacagtgaaaccccatctctactaaaatacaaaacattagctgggcgtggcagcgcgcacctgtagtcccaactacttgggaggctgaggcaggagaattgcttgaacctgggaggcggaggttgcagtgagctgagatcgcaccactgcactccagcctgggtgacagagcgagactccgtctccataaaacaaacaaaaaaacgagcaaaacacaaaaaacaaatgaacagcataaaggagcttatgttacatgatttcatttatgtgaaatgtccagtataggcaaatctgtagaggcagaaagtagattagtggttgccagggcagggggacttgggagaaaatggggattgactgctaacgtgtatggggtttcttttgggagtggtgaaaatgctctaaaattgattggggacttggttgctcaactccaaaggtatgaaaatgaaaacccatgaaatcatacactttaaataggtaaattatgtggtatctgaattatatctcagtaaagctcttacaggaaaatgttttaaaaagtaataataataggggccaggtgcactggctcacgcctgtaatcccagcactttgggaggccgaggtgggtggatcacctgaggtcaggagttcgagaccagcctgaccaacatggagaaaccccacctctactaaaagtgcaaaattagccggacatggtggcacacacctgtaatcccagctacttgggaggctgaggcatgagaatcgcttgaacccagaaggtggaggttgcagcaagccgagacagcaccactgcgctccagcctggaaaacaagaggaaaactttgtctcaaaataataataataataataataataataataataataataataggccccagcacaatggctcacgcctgtaatcccagcactttgggaggccaaggcaggtggatgacttgaggtcaggagttcgagaccagcctagccagcatggcgaaacctggtctccactaaaaatacaaaaattagcctggtgtggtggtgcatgcctgtggtcccagctacttgggaggctgagagagaagaatctcttgaacccgggaggtagaggccacagtgagccgagatcacaccactgcactccaggctgggtgacagggcaagactccatcttaataataataataataataataataataataatggggtaggctgtgatcatgacctaaaccatgatctatgtttgaacatctgcacttactatgtgctcaactagcctgagccaaaatgagcaaggaggggagcagaatacattagctcacacagttgaaaaatccaggagtatttcaggtatggctggatccaggagcttaagtaatgtcagtgggactttgtcttgctctatttctccagttcagatttgccctgtgctgccttccttttcaagtaggtgacaaaaatggccttggcagctctagactgctgagctcttactaccctgagggagtatctttttccttatagtgtttagtaaagatctgatggaaggttcacactgatctgactggggtcacttttgaattaatcgccatagccaggataattttctgctctggtgggctaagactgggtgatacaacccattctagagccaggtttgtggtcagcttcacccaaaccatatagattataggggtggggtagttccccaagggaaaattaggattctgggcaggctcaagtcacagatacccacagtattcggacagtgtggaccctgctgcccaggtttgacccttgctttttccacatgccagctatgtgaccttggcaaagttctttttttttttctttttttttttttttcctgagatggagtctcattctgtcacccaggctggagtgcagttgtgtgatcttggctcactgcgacctctgcctccggggttcaaacgattctcctgcctcaacctctcaagtagctggattacaggtgcctgccaccacacctggctaatttttgtattttttggtagagatggtgtttcaccatgttgggcaggctggtctcaaacccctgacctcaggtaatctgctcgcctcagcctcccaaagtgctggtattacaggtgtgagccactgtgcccagcctccccagattattattattattattattttttttttttgagatgtagtctcactgtgtcacccaggctagagtacagtggcgcaatcttggtttactgcaacctccgcctcccaggttcaagcgattctcctgcctcaggctcctgggtagccgggattacaggcgcaagccaccacgccaggctaatttttgtattttagttagagacgaggtttcaccatgttggccaggatggtcgcgatctcctgacctcgtgatccacctgcctcggcctcccaaagtgctgggattacaggtgtgagccaccgcacccggccccccagattattctttacaatggacaatccacagccacaaagctaagagccaggtgcttggtttttcaattttttttctttcttttctttctttcttttttttttttgagacggagtctcgctctgtcacccaggctggagtgcagtggcgcgatctcagctcactgcaagctccacctcccgggttcacaacattctcctgcctcagcctcccgagtagctgggactacaggcgcctgccaccacactcacctaattttttgtatttttagtagagacggggtttcaccgtgttagccaggatggtctcaatctcctgacctcatgatctgccctcctcggcctcccaaagtgctgggattacaggcgtgagccaccgcgcccagcctgttattttttctttaaacagtgaagagggtttcaaggaatctctccttaaaggcaaagaccctgcccaactgagtgttgaggcctttgtagtggactgacctgggttaatttctggctctgggttctgccttgggcaaatcactttctttctctaagcctcagtttcctcctccatgcaatgggcagagtagaggggaataaatgagaatcatctcaagtattgactggctcagcacagtgcctagaatctgtgtctaataagtgaacttttattttcccttttttttacttgtttatttgactacatgaataccttcaaaaagtacagagtgaaagtaaagagtgaaaaatgggtgggtctcccttcctccctgttcctttacccacccacttccctttcagagatataatcaggattacaggtttcaaaacggttttgaatttataggactataacaagaataattcagagaattccatataccctttacccagaatcacctgtctttactattttgccatgtttgttttattatcttttctttcttcatgtgactatgtttattattattatttttctgaactattatagttttcatacatcatgccgcatttacctcttaatatttccgcatatgtttactaggaacacgatattatttgctgtaaccacagcactgttaccaaattcagaaaatttaccttgatgccccatttacctcataatatttcagcatgtatttcctaagaacaagatattatttgctataggctgggtgcagtggctcactcctgtgatcccagcactttgggaggctgaggcgggtggatcacctgaggtcaggagtttgagaccagcctgaccaacatggcgaaaccctgtctctactaaaaatacaaaactagccgggtgtggtggtgcacacctgtaaccccagctacttgggaggctgaggcaagagaatcgcttgaactcaggaggtagaggttgcagtgagctgagactgcaccactgcactccagcctgggcaacagagtgagactctgtctcaaaaataacataaaagaaaatagatattattttctgtaatcacagcagtgttactaaaaaatttaccttgattaccatccatacgccaattttgtcagttgtggtaaaaaaaaaaaaaaaaaaaaaaagaatcccttacagctttttcccgcctagtgcaggatccacttcaggaccatgttttgtctgtcttttttattttttttttcttgagacggagtcttgctccgtcacccaggctggagtgcagtggcacaatcctggctcactgcaacctccacctcctgggttcaagcaattctcctgtcgcagcctcccgagtagctaggactgcaggcgcctgccaccacgccctgctaatttttgtatttttagtagagatgggatttcgccttgttgatcaggctggtcacaaactcctgacctcaagtgatccacccacctcagcctcccaaagtgctgggattacaggcttgagtcaccgcgcctggcctaattgtctctcatctgaaatgatgcctctgcttttctttgtcttttatgaccttgacattttttgaagaatacaggccagttatttcatagaatgttcctcatttggggtttgtttaacagagtaccccaaatttctgtaggataggaattcaggaagggcatagtggggaaaaattctatctgctctaaggctcactcctgtaatgccagcactgaggcctcagctggaaaactcaaaggctagaagcgagagttacctgaagtctcactgtctggcagctaatgcaggctgctggctggggcttggctgaggccccacacacagcctctctacgtatcctgagcttctttccaactatggcagctgggatggaagggcaagcatccaaatggagaaagccatactgtcttttttattttttatttttattttttgagacggagcctcgctctatcgcccaggctggagtgcagtggtgagatctcagctcactgcaaactctgccctcagggttcaagtgattcacgtgtctcagcctcccaagtagctgggattacagacgcccgtcatcatgaccagctaatttttttggagacaagagttttgctcagtctcccaggctggagtgcagtggcatcatctcagctcactgcaacctccaccttctgagttcaagtgattctcctgccttagcctcccgagtagctgggattacaggtatgtgccaccacgcccagctaatttttgtattattactagagatggggtttcaccatgttggccaggctggtctcgatctcctgatctcaggtgatccacctgcctcagcctcccaaagtgctgggattacaggtgtgagccaccgcacccagccactaatttttatatttttagtagaaatgggattttgacatgttggccaggctgggtttgaactcctgacctcaagtgatctgcccatctcggcctccgaagtgttggcattacaggcgtgagccgccacacctggcctgtcaatattgttttaatgatggttgctccttctcaggctttcctcacatactgttttttttttttttagacaggttctggttctgtcacctaagcctcctgagtagctgacattacaggtgtgtgccacgagcttggctaatttatttatttattatattaaatatatatatatttatatataatattaaataatatatgtatatatatttatatataatatatatattaaataatgaaatatattaaataataaataaataaataatttatttattgttttgtagagatgggagtctcactatattgcccaggctcatctcaaactcctggcctcaagcattccttccacctcagcctcccaaacggctaggattacaggtgtgagccaccacacccagccctccctcatacattcaaatggccaactcccttggcttcctcaagtctttgcttaaatgccatcttctcaggaagtcattttctgaacactctattaaaaattgcaacctgcccccaaacacgtcttgcactcactgtccgtgtctctgcttaaattttctccgtagcactcataccatctaacatactgtgcatttacttgtttatttttatttttttgagacagggtctcactctgttgcccaggctggagtgcagtagtgtgatcatggttcattgtaacctctgtctcctggactcaagcaatcctctcaccttagcctcccaagtagctggtaccacaagtgcacatcatcacacctggctaatttttgtattttttgtacagaaggggtttcgccatgctgaccaggctcatctcaaactcctgggttccagcgatccacccgcctcagcctcccaaagtgctgggattataagtgaaccatcatgctgggcaatttatttatttattttccgtttccctctactaatgaatcagctccaggagtgcagggaccttgtctgttttctacacagatgcgttcccagcacctagcacagtgcctagcaggtatgtgaatgaatgaatgaatgaatccatgcatgcatgaatgaagtatccttgtacaaaccatgaaccatgtacatgttaggtgtctacaacttgtcgtttgaattaatgaataaaagaacaggcaaggcgcggtggctcacacctgcaatcccagcactttgggaggccgaggtgggcggatcatctgaggttgggagttcaagaccagcctgactaacatggaggaaccctgtctctactgaaaatagaaaattatccaggcgtggtggcgcatgcctgtaatcccagcttgggaagctgagacaggagaatcgcttgaactcgggaggcagatgttgcggtgagccaagatcgtgccattgcgctccagcctgggcaacaagagtgaaactctgtctcaaaaaaaaaaaaaagaaagaacagacagcaccaaccctccttgtaagttcaatatgaggttgatctgaagctgccacccaaggctactgatcaaaatatccttctaaacaagtctgtcccacagtcctggcgtctgataatatggacagtcaggctggctggcaccagactggacccagatgaaggaatggaatcaggccacattacaggggcaagaggagccttgtggccagaggttctagaggtcagcagcaagtcatgcatctgaagaggaagttgattgctgtacctcaagctgaaacagaaactgcggtggctagcaaggaagggtccccacctgtgcgcctcagccccttggccattgccagcttccaacagaccacagagacttttgggggaaaacttttttattgaagtgtaacagacatacagaaaagtgcacaaataaggaaagtgcacaggggagcgatggctcgatacattttcacaaaggcagacagcggggtaaccagcccccagctcaaggaacagaacattccccgccccggagaagctcccttcaagtctttcccatcctaagcgataaccgttatcctgattccaacagcagtgatgatttttgccgttttttgaacttgatgaaatggcagcacataacacgtattcttttgtgtaagacttacttactacaaactttgtatgtttgtagcaacagccttttgaccctgtctcttcctccatgccctcaaagagaaaaaggaacctaataataacacaaaataaagcgaaagcatacttgcttgactggtttaaatgtgccatctggccgggcattttggaggccgaggcgggtggatcacttgaagtcaggatttcgagactagcctggccaacatggtgaaaccccatctctactaaaagtacaaaaattagctgggcatggtggtgggcacttgtaatcccagctacttgggaggctgaggaaggagaatcgcttgaacctgggaggcaggggttgcagtgagcagagatcgtgccactgcactccagcctggatgacagagggtgactccatctctcaaaaaataaaataaaataaaataaaataaaataaaatataaaataaaatgtgccatccattctttcatgcttcagccacccagtgggctggaactgttactgcttccatttcaaatattgggaggctgaggcacagagaggttaaataatttgctcagccaggaagtgaaggtctgtatttaaagccaggtctctctgatctccaagctcatgttctaacccagcatacactccttatcaataaaatgaccatgtattgaacaccctctttggactgaatactatacttcaactttatgtccattgtcttatttgattttcccagccgttgatgagtaatataccattatccttgcttagcaaatgatgaaagcagggttcagagaggttaaggaactttcctaacgtcatacagcccaggaaggcatgaaataaaaatttaaactctattttgttgattccaaagtccagtgcagaacgatatcagtacccagcatttatgcgcatctttcaaatataccttctgaggccctgcagggtggctcatgactgtaatcccagcactgtgggaggccgaggtgggtggatcagttgaggtcaggagttcaagactagcctggccaatatggtgaaaccccgtttctattaaaactacaaaaattagccgggtgtggtggcacacgcctgtaatcccagttacttgggaggctgaaacaggagaattgcttaaaccccggaggcagaggttgcagtgagccgagattgcaccactgtactccagcctgggtgacagagcaagattctgtctcaacagaaacaaacaaacaaaaacaaatataccttctgagtttttcaaaaaagagacaacaatagcagttaccttttatggatcatctcagagtcagttgttttggtcaaagattgcaaatgatcccttaatttgtgttcttgtcttctctctcctagtaagagtatacctgatttttagcttggcacatggcttcccatggctttactacctatctcagccttccttgcagctaggggtagccacatgactaacttatagccagtgaagaactgttccccgacatgcccacatggctcatgtcaaccccagcattacatcatttgtttaaactctcagtttctctgtcttgaaaatagggatttaaatatttatttaagccaggtgtggctgaggtgagaggatcacttgaggccaggagttcgagaccagcctgggccacacaatgagacccctgcctttacaaaacaattttttaaaaaaattagctgggcatggtggcgtgtgcctgtagccccagctactcaggaggctgaggtgggaggattacttaagcctgagaggttgaggctgcagtgagccttgattgcgccattgtgctgcagcctggatgacagagcaagaccccatctcaacatatgtgtatacatctatctatctatctatctatctatctatctatctatctatagctatatctgtctcatctctctctctctctgtctatatatatatatatatatatatatataaataaatatgttcttttttttttaatttaacaaaagcaggaagtagacagacacagtgggtggttcatgccagtaatcccagcactttgggaggccaaggcgggaggattgattgaagccaggagtttgagaccagcctgggcaatatagtgagacccctaactctacagaaagtttaaaaaaaaaaatcagctgggtgtggtggtatatgcctgtagtcccagcttcttcacatcactgcactccagcctgggcaatagagcataaccctgtctcttaaaaacaaaaaacaggaatatatgtagtagagtcaccttgagtgtggattgggagaagaagctaggacaggaaggacactaatgtgtttgtgttgggtaaacaaaccctgtttattgggagaccacctgctccagaagaaaagacaccaggtgaagacaggaagctgggtgctgctaactgaatgagctgggacaaggcccttcccttacctagggatagataataaaaaatattttattgtatatttttaaggtagtagttccttgtctgcagagtggggatttagattacatctatccttttggttttgtctactcactatgaattcccctatcataacagcatcctaatttctctgggagcccccttctttactccctgtccatgtgaaaggcatgcagcactaactttatccttggttccaggaaggccaatgctccatgctggccaatcagcacccctcatttctctgcccatagggattggctcagaaatgggcacctgccccaagtggaccagtgagttatccctcaggtttttgctgggattgttttgcttctgctgcgctaggctggtatgaagagggtctgaagctcaaaggtagccaccattgtgagagtgaaagactgagccctgataacttatgaacccctgaatccagctgtacctgaaggcagccacatattcctgaacatgttattctccatgagtcaatatggttcctctttgttgtttttttgttttttgtttttgaaatggagtctcgctgtcacccaggctagagtgcagtggcaccatctcagctcactgcaacctccacctcccgggttcaagcaattctcctgcttcagcctcctgagtagctgggactatgggcacgtatcaccacgcccagctaacttttttgaatttttagtagaaacaggattttgtcatgttggccgggctggtcttgaactcctgacctcaagtgatccacctgtcttggtctcccaaagtgctgggattacaggcatgagccaccgcgcccatcctcaatatggttcctctttggacttaagtcactgtagcagatgacgtggcttctgtgtccatatccccttggcattcatccttttgacccacagtgagtggatggcttcaaatttccacgcctatctttgcagcctgagggctttgctctcatatacgctctgcatacacagtctgagaatgctgggggcttcaccctcccctacaagcagcccttaaccaatgagtgacaggggctggtggataaatgtccccactcccttgcccttcacctggataattctgaggtgtattgcactctgtgtcccacagttccccagcagggttgagccccagctgcccagagtgataacctgctcagtaacttaccttctattggtttctttcccttccctgtcctacttccctccccgaccagagcttcctgggatcatttctcaagtaaacgatttaatatctgcacacaaatccttgtctcagatctgcttctgcaggaaaccaacctaaacgtttcgtaagattggttttctgtcacgcacagctaaagctgctctggcagacgcatggttcaagaattcttttaaaatatttgcctcataactgtatttttccagcctgcttttcagctcaaaggaagtatatgcactgagttgacttatcagtgtgcatagcagaaagggacccagtaagagaaagccccctgagaggccctgggacagctgagtgatccaccctggctgcctcctctccacctcattctcacacactaacctttcccaacccttttcattccaaggctcctagccagcgccccccacctgccttaggagataaccccagttccttcctcggattctttcatctgcaaggcctcagtgttcttgtccggccagtgataaggacattcaacgtcattttcctgtccctgacctttgaaagaaccctacccatctggggcctgtgatgtagactcagactgagatgttccatcttggggatataatcagtgggaaagagagagattcctgagaggtcatcattcattcattcattcattcaagaaatatttatggagtgcttgggcaaggaattctaaattgcagagtcaactagagccagcttaagcagaaaaggaattttttttttttttttctaagatggagtcttgttgcccaggctggactgcagtggcacaatctcggctcactgcaacctccgtctccagggctcaagtgattctcctgcctcagcctcccaagtagctgggattacaggtatgcaccaccacgcctggctaattttttgtatttttagtagagatggggtttcaccatgttagccaggctggtctcaaactcctggcctcaagtgatccacctgcctcggccttccaaagtgctggaattacaggcataagccaccgtgcctggcccacaaagggatttatgaaaggtaggaagtactctagatgttaaatagccacaaacggtgcagccaggagcatcgatgccaggagcaacactcaccttcactgttgaactgttctaatcaaaatatcactgctgctgctgcccccctctccccaaactcaggacctaggtagctagagacaggctgctagaattgccccatgcttccccagaaggaccagataccgctcccactgtgcttgccagaagactccaccacttggcatccttctgcttgcttctgtctccaaggcttactaggggaacccagatcacataaggcactcttgctgcaaagaaatctcagaatgtagtttttctctgtctggcctttacagtacaggaggtcacactacaggggaatgggataggtgagtgagccaatctgtagtatctgccgtaggctcacaacaatgataaagtcagggctgggcacagtggctcatgcctgtaatcttagcactttgggagaccaatgtgggaggctcccttgaggccaggagtttgagaccagcctaggtaacagtgggagaccactccatctctaccaaaaaaaaaaaaattaagtggtggtgtgtgcctgtagtcccaggctgaggagggaggaatgcttaagcccaggagttcgaggctacagtgagctacgatcgcaccactgtactcccgcctgagcgacagagcaagaccctgctctaaaaaagaaaaattaaaataaaaaaattttaatgataaaatcagaagagtcccctgctttccaggagctcaccattgacaggaggatatcaacaccaagcaattccaggagggagagcattccaaaagggaaattatagacagttacacacacatagaccaagaaaactcaacctattctaacaggacctcctgaaacaggtgccgttgtacatgatgtgtgaaggtgtttagaggctaaccaggcaaaagaagggcaagagggaatagcacttcaggcaagggaaaatctcatatgcaaaggtccagtggcagggaaggtgaggggtgcaggaggaagtgagagaagcccacttctctctgactggagaacagagaacaaggggaacagagggaaggaagaggggcggtaagggaatagaccatgaccttgtggtccatgatgtggaattcaaactgtctcctaaggccagtggtgaccactgaatgcttatgagtaaggcagtgacataatagcaactgctaatatttatttatttattattttgagatggagtttcactcttgctacccaggctggagtgcaatggtgtgatcttggctcactacaacctctgcctcccagttcaagcgattctcctgcctcagcctcccaagtagctaggattacaggagcctgccaccacgcccagctaattttttgtatttttagtagagatggggtttcgccatgttggccaatctggccttgaactcctgacctcaggtaatccccccaccgtggcctcccaaagtgctgggattacaggtgtgagccaccgtgccctgcctgctgatatttattgaccacttattcagtgccagacttttttctaagctgctaacatgtatcatttagtatgtatttgcaacaaccctgtaattaaggttctccagaccacgagcaaattactcagccattctgtgcctcagtttcctcatatgcacaatgggagtaatcatagaacctaccacaaagagttagtatgagggttacaatgagtgcttggcacatgggaaatgctgtgtatgtattagcttttgctactattattcccattttatagatgaaaaagctgaagcccagagagatgaatcagtttgtctgaggtcacacagctaatgctaataaggcatagaatgaacaggacaggtgtggcgaaggtagaagtgctggtgggcgtggagaagccacatcttcatcctaggagtgatggaagtgtggaccacccattgggacccatgtggccagcctctgttctgactggtcagtgcctaggtcatgccggttcttaaatatttcattatcaccctgttattactacatatatgacattgttttgtggatttaatatttacacaaacggtatcatactaaatgttaacttctgcaagtcccttttctcactcaacattactgtatgtttaagatctgtttagatctagttcattcattttattttcttttttagagatggggtgtcactatgttggccagtctggtcttgaaatcctgggcttaagtgatcctcccaccttggcttcccaaaatgttgggatgacaggcgtgagacaccgtgcccagccattcattcattgtttttttttttttttttttttttttgagacagagtctcgctctgtcacccaggctggagtgcagtggctcactgcaacctctgcctcctgggttcaagcgattctgcctcagccttctgagtagctgggactacaggcacatggcaccacacctggctaattttgtatttttaatagagacggggttttgccacgttggccaggctagtctcaaactcctgacctctcaggtgatccacctgccttggcctcccaaagtgttgggattacaggcgcgagccacaccattcattgattttaattgctcactagtattcctttacaggaacatgtcatggtctccttgcccactatcccatggatgcctatttagtccactgcactttggacccattgtaggcaaagctgccacacccaactttgcatatgttgaagcttctctagggtgaataccaggaagtgggatcactggtctcagagttcatacgtttcaactgccaagcagcagtacatgaagagttcttgtttctgcacttccttaccgatgaaaataataccactaccccacatgacacttactatgtgccaggcatctttctaaacatctaacatgaaataactcatttaacctctcaaaaaactttgaggtgaggtactatcatcatctccactagatagatggagaatgaagacacagagagggcaaataactagcccaaggtcactcagctaggaatagtagagcatggcatgaacccagagaggctggttccagagcctgggctgttcatcactcctgtaggccttggaattttctggttttcaagttgctgccagtttatgactgtgaaatgtctctaagtgctttaagttgcattgcctgcttagaagggaccttgaggacctttccatccattttttggccaatcaagcatcctcttcagaaaaatgcctctttctagccttggctgtccctgagtttctgatcttttctgcaagtatgcctggaggccaggacttggggcggggcctggcacagtgagcgcacttggtaaaaatgtaccagactcaccaggcatggtggctcatgcctgtaatctcagcattttggaaggctgaagcaggcagactgcttgagcccaggagttcaaaaccagactggtcagtgtagtgagaccctatctctacaaaataaaaattaaaaattagctgggcgtggtggcacatgcttgtagtcccagctactcaagaggcctctgagatgggaggatggcttcagcccaagaggtcgaggctgctgtgagctacgattgcaccacagcactccagcctgagtgacagggcaagaccttgtctttgggaaaaaaaaaaaagtgttcactttggcagcgcatatactaaaattggaacaatacagagattagcatggcccctgtgcaagaatgacataaaaaattgtgaggtgttcgatatacaaaagaaaaaagaaaaaaaagtgccagactgactggtggtgtctttcacgtctctcaccctctcttcctcctgggaggccaatgctgatgaataaagcttctgcttaagtcactggcccacgtctgtgctgtgctgggcacgcacagtggccctcttgcctcaagctcatttcctcttctgttatctgaccctaatctagttcatgatctgatctcatctccttcgactctccttgtctcttgtttctcatgaaccccactggctgtcctcctgtctcttcagtggccaagttcatttctacctcaggacttttgcatgtgctgcttcctctgcctggaacactcttcccgtagtggctccaactcatccttcaggcctcaactcaaatgccacctcctcagagagactttcctgatcactctgtttagaagaaacagaggcatgaagagattgagcataattgtcaaaaattgtacagctggcttattgatgagatttttgaattatgttatcttattatgtgcctatatttctaaattttttctacagtggtgatgtgttccctgtgtgaattttttaaacctcaaattcaggctggacattgaggctcatgactataatcccagcacttagggaggctgaggcgataggatcgcttgagctcaggagttcaagaccagcctgggcaacatagtgagaccccatctctacaaacaattttaaaattagccaggaatggtggcatgcacctgtagtcccaggtactggggaagaagaggtgggaggatgtcttgaggctaagagttggaggctggagtgagctatgatcacaccactgcactccggccaggataacagagcaagactgactcttaaaaaaaaaaaaaacaggccgggcgtggtggctcacgcctgtaatcccagcactttgggaggctgaggtgggcagatcacgaggtcaggagatcgagaccaacttggctaacacggtgaaaccccgtctctactaaaaatatttaaaaattagccaggtgtggtggcgggcacctgtagtcccagctgctcaggaggctgaggcaggagaatggtgtgaacccaggaggtcgagcttgcagtgagctgagatcgcgccactgcactccaccctgggcaacagagcgagattccatctcaaaacaaaaacaaaacaaaacaaacaaaaaaagcaaaaaagaaagacctcaattgttgttgttgttgttgttgttgttgttgttgttttgagatggagtcttgctctgttgcctaggctggagtgcagtggcacgatcttggtttactgcaacctccgcctcccaggttcaagcaattctcctgcctccgcctcgagagtagctgggattacaggtgcccgccaccatgcctggctaatttttgtgtttttagtagaaacagggtttctccctgttggccaggctggtctccaactcctgacctcgggtgatctgcccaccttggcctcgcaaaattctgggattacaggtgtgagccaccacacccagccaagacctcaaatttaaaatgaattaagagccaatcctgagagaatacgaatgagtgtctggggctctgtttttcaagcctcctgggtcagaataagatcatagcattcttcatcctccatgatttccttactgcccactttcccacgcctttccatctgacgatcgtccctcttggctctgaatcagaaggctaaaagcaaagtgtaggtccacaatcctctctgataatcagcctccccttccctacagatgtttctcattgcaaaatgggaataatgccaggtgcggtagctcacacctgtaatcccaacagtttgggaggccgaggagggaggatcacttgaggtcaggacttcaagaccagcctggccaacatggtggagccccatctctactaaaaatacaaaaattagttaggtgtggtggcatgcacctataatcccagctacttgggaggctgagacaggagaatcacttgaatctgggaggtggaggttgcagtgagctgagattgtgctactgcactccagcctgggtgacagagagagactccatctcagaaacaaaagggataataaaagacctacttcacagggattcagcatgatggggctgaaagacatttggcggaaggaagactattgctgtgtgggaaccgtactgtgtggtgagtttggagtcagataaactctggatcaaaggccagctcactgtgtgatctcaggcaactcaatctctgagcctcactctctctgtaaaataaggacaataaaaatacctactgagttctttagaatgcccttcactagaaagaagtgggtaacaaaactcaagcgtgctttactggaacaggctcccctggctccccacacaggacatttctaggacgggggagcaggagatccagcagcctagtgatctcatcctggagccaggctttttccatgtctccgtccacagtgttggtttcatcctcaggctggtcctcctcgtgatcgcaggatgactgccaggagctatcagggccacgggcatcctctttcatgtctggtaggaaaatagattcacttccaggccatcttcctggaagagtgaggaagaactttcccagaagcgtctggcaaacttctctccacttctcattagcctgaggtaggtcagaggcccattccggaaccaaactctggcaaaaagatgcaagtctcatgattggcttagactcattggttccagtgcctgtggctgggctgggatggatgtcgaggagtcagtcaacaacattgtcctctctacctgcctcgaacagttactgggagaagaaaatgagatcatgcttgcaaagcttagcatacagtaggtgctcaactaataatagctcttattactattacaggctgagtatccctcatccgaaatgcttgggaccagaagtgtgtcagaattcagattgttttggattttggaatatttgcattatatttaccagttgagcattcctaatctgaaaatctgaaacccaaaatgctccagtgagcatttctgttgagcattacgtcagtgctcaaaaagtttgggattttggcgcatttcagatttcagattttcagattagggatactcaactgtattattattattttcttttttgagacagggtcttgctctgtctcccaggctgagtacagcagtgcgatcttggttcactacagcctcaacttcccaggctgaagtgatcctcctgcctcagcctcccgagtagctacctgggaccgcaggtgccaccacaccaggctaattttgtttagtttttgtagagaggaagtctcactatgtttgccaggctggtcttgaactcctggactgaagcgatcctcctgcctgggcctcccaaagtgctgggattacagacatgagccaccgcacccagccttcaacagtattctgattattatcaacatcaccatcatcctttgggggctttgatgtcaggcaggctctgatcaaatcccagtttctccacttcttagctgtgtggcctcatgcaagttgctgagcttcagttccaccctgcaaaatgggaatgataagtgctcctatctcttgtcattactgtatgaaaatagttaatgctccgtatgtgccgataatgcagtcctttggccttcccattaggaatttgggtggccttttcctgccctcagtagatgtgattcaggtgagggagactctcccttctattccagaagtgggcacattctcctcacttgaatttctgaatccctcaggtcgatatgattggttcagggagccagagaaagagagtctgtctatcctctagaattgctggctggaaaagtggaagctaggagctgcgggaaaccatcttggggagagctggcttgaagtggagccaacaagagaggaagcagagatgagagatggagagaggcagaggactgttgactctgttgagctcctggatccagccatgcctgaatcggatttaccactggacttttcattatgtgagccaataaattccctttttttttttgtagaagaagccagtttgaggcgggggttctgtcacttgcagtgatgtgtgtggagtctagtccagaccaggcaggatggggaattagaaaaggagatagtcctctgagggcagaattatgcctacctaaatcagcttggtattccaagagttttgcccaggccaatgcatagaatggaactccagaagtattaggagttaaaagcataaataggctgggcctatttgtgccctataatcccagtactttgggaggcctaggtgggaggttcgcttgagtccaggagttcaagagcaacgacaacagcctgaacaacacagtgagaccccatctctgcaaaaacaaaaataaaaaattagctgcgaatggtggtgtgcacctgtagtcccagctactggggaggctgaggtaggaggatcgcttgagcccaggagtttgaggttgcagtgagccactgcactctagtcggggtgaccgggcaaaacctcatctctaaaagtaaaaaaaataaaaataagaacacaaatagagtctagtgagtatccctccagacttcttctctgtgcttataataaatagtcatatacaaacacagaagaatatttttacaaaaatggaagcacactctacattttcagttcaaacactccctccccagtgaccaccccatctgaagtggctccgtctccatcatgctttcttgcatgctagcgtttttcactccctaaattaacttattcagagcagacatttttctctgtttgccactgctgtgtcatcagtacctttcacaactggccaagtatccaacacacatttgttgagtaagtatcactctgtagtttgtgtgtttcttttaacttgtagcgaagtagacatggatctgctttgacctttgagacgaatgcatggagatctattgatcggatgggccacgtttgtttcccacacttcgttgaaaaattgggggtgaaaaaaactgggagtgaaaaaatggccaaaccaaaagaagggtgagtcattccctcctaccccaaaatacagaggagagggtgaagaaggaggaccgcccctcctcgctccagtaaagcctttaacaggcccatcctgatttacagggagcggacttggtttcctgttcaagaatttccaaggcaaaaacaatcctcaaacacatgaagatgaggttgggcaaataactcatggatggtctcaacgctggagggcaaagttgtttattaagctcccgaccctcaaagggaattacttaaatttttttcttgattataaaagtagtattccagcctgggcaacaagagcgagactccatctcaaaaaaaaaaaaaaaaaaaaaaagtattggctcatcactatgaaaaagcattttcagagaatacagaaaagtgtgaggaatagaataaaaaacagtcataattttggagcattttgtaagttagcccatagattttttaaatgcatacacatgtacttaattctaaagtgaacctgtgctatctttttatttaacagtaatcctaagatttattgagtatgtacaatgcatatgctagttgctctctgtgtattaatccattttatatttacagtagtcctgtgtgataagcactattattaattcaattttatagatggggaaactgaggcagagagcagttaagtgatttacccaagatcacacaaggtggccaagctggaattcagaaacaagtaatctggcttcaaggcccatgacgttaaccactatactacattgctaaggcagagcagagacccctcccaagttaatacccatagatatgagtcatcctttttagtgcctgcacttattcttctattactagataattgggctttttctagtttccccctactaggaaatagagagaaacttcccttttgggctttaaattagacaagaaaatatgcggttagatgtcaccacaacttgtacttcttttttttttttttttttttgagacagggctcgctctgtcacccaggctggagtgcagtggtgcgatcacagctcactgcagctttgacctcccaggctcaatctattctcccgcctcaatctattctcccacttcagccttctgagtagttgggactacaagtgcacaccaccgtgcctgactatttatttctcttttctgtagacatggggtctcactgtgttgcccaggctaacaactggtatttctaacccaggagaagcaacgaagggctcagccctactttgaagcaatcgccccattatgcacatatatattgactgggggaggttattttatttaagaaacatccatgaagtacttatgtgccagacagacatggcttcaagaacttctgaataggctgggcacggtggctcacgcctgtaatcccaacactttgggaggccgaggcgggcggatcacgaggtcaggaattcgagaccagcctggccaacatggtgaaaccccgtctctactaaaaatacaaaaacttagctgggcgtggtggtgggcgcctgtaattccagctacttgggaggctgaggcaggagaattgcttgaacccaggaggcagaggttgcagtgcagtgatccgaggtcacgccattgcactccagcctgggcaacaagagtgaaactctgtcttaaaaaaagaaaaaaagaaaaaagaacttctgaatattagctcacttcacccaaaaataatactctgaaatacataccagggaaactgaggcacaagggggttaacttgcccaacatgacagaggcagtaagtggcagtgctgagatctgaaccccggaagcttggctccagtgtctgggttcttaactcccaatcagcctctctgtctaccccttggcccaagagagctggcccgccctggggtactcaaagcaaacccactttcagctgaggactgacggcagcaaggtgaatatatctatttttccttttaagtgatactcatgtattagctcacagttctgtaggtcctaagctcatgcaggctctgctgtgttatacgttcagggcatcacatggctgaagcagagatgtcagctcactggagtcctcatctggaggctatgggaggaattggactcttttcagattgttggcagaattcagttccttgcagctgtagaactgaagcccccatttccttacttgcgattctctctgcaactagaagcttcctgcattccttgtcctgtggccccttcttttttttgagacagagtctcgctctgttgcccaggctggagtgcagtggcgtgatctcggctcactgcaagctccgcctcccgggttcatgccattctcctgcctcagcctcccgagtagctgggactacaggcgcccgccaccatgcccagctaatttttttttttttgtagtagagacggggtttcaccatgttagccagaatggtcttgatctcctgaccgcgtgagccacccatctcggcctcccaaagtgctgggattacaggcatgagccaccgcgcccagcctatatctttttatttatggcaaatattttaactgtcccacagatttgtcttgaataagaagcaaagagacgggaaaaccccttagaaacaggtgtgtaatgggacttttcttttgtttcagttttggttaagggcttcgtgctgaggtactgtggctctctctagagacagctgaatgtctgctgagttagaaaaggggagacttccccaaaccgtctatgaacccttagcccatcacctgtgttgagggtgtaccgggaagacttgaggattactgaggggaaaatagaggttatggagaaagtttccccttcattgaaaatgcctgggcagggtgcggtggctcacgcctgtaatcccagaactttgggagaccgaggcgggtggatcacctgagattaggagttcgtgaccagcctggccaacgtggtgaaaccccatctctactaaaaatacaaaaaattagctgggcgtggtggtaggcgcatgtaatgccagccacttgggaggctgaggcaaggagaacccaggaggcagagattgcggtgagccaagatcgcgccattgcactccagcctgggcaacaagagtgaaactccatctcaaaaaaaaaaaaaagtttgcaaaaataaaaaaataaaaaataaataaagggccggggacagtggctcactcctataatctcagcactttgggagacacgggctggcagatcccgtgagccaaagagttcaagaccagcctgaacaacatggcgaaaacccgcctctacaaaaaaatacaaaaattagccaggcacagtggttgtgcctgtagtctcagctacttgggaggctgaggtggaggatcacctgagcccaggaggttgaggccaaagtgagcagtgattgtgccactgtatgccagcctgggtaacagagtgagaccctgtctcaaaaataaaataaaataaataaaaattagaagaagaaataattgaaaattctgaaaaacataaaataaaaaaggcagtttccttggagttttctgtgctactgtggacatagcacatagtaggtgcttaatccatacttaatgatttatgtcaggtgctagtctaggtactagaccccctgtgagcctaatggggatgacaggtcacaaggaagtaaatttgaaaaagaaacaacattgtgctaagtgaaagaagccagtcataaaatgccacagattttattccacttacatgaaatgttcagaatccgtaaatccatagagacagaaaataaagtaatgactgccaggggatggggcagcagggagtgactgctgataggtgcagaggttcttgttggggtgccagaaatgtttgggaatcagacagttgtgatggttgcataacatagtgaatacactaaaacccactgaattgcacatgttaaaatgaagtttttgttatatgagttgtatttcaatatttatttaatttaatttaattaattaatttattttttgagacagtcttactctgtcacccagactggaatgcggtggtacgatctcggctcattgcaatctccacctcccaagttcaagtgattctcgtgcttcagcctcccaagcagctgggattacaggtgtgcaccaatacgcccggctaatttttgtatttgtagtagagatggggttttgccatgttggccaggttggtctcgaactcctgacctcaaatgatccgcctgctttggcctctcaaagtgttgggatcacaggcatgagccatggtgcctgggccatatttcaataataatttcaaatatgtttttttaaaaaggacaaaacagagtaacttcacataataggtaccacgaggacaagagagtgaaatgctggaagatgcagtggctggctggggcaggtgggagacggcctcagtcagggtgcttccattgtatgggatctgaattatgactaggaggcagctctatgtatatctagaaggtgatagacaaaggaacagcaagtgcaaaggtcctgagctggggaggagcatggcatgttcaaggagcagataagtgagttgggatgcaggggaaaagggacaagagaccccttcagggaaagggagctgaccaaacagggccttgcagactgccaagaggagtttgggttttgtttgcagtaaaatggggagccgtgggatgattttgagcagaagagtaacatgatctgatacatacttcaaaaagactgcttgggccaggcaccatggctcatgtctataatcccagcactttgggaggctgaggtgggagaatcacttgattgagcccaggagttcaagatcagcctaggcaacatagcaagaccccgtttctacaaaaaataaaataaaacaaaaaattagccaggaacggtggcacgtgcctgtaatcccagttacttgggaggctgaggtaggaggatggcttgagccagagaggttgaggctccagggagctgtgatcccacaactgcactgtagcctggggacagaatgagaccctgtctctcaaaaaaaaaaaaaaaaaaaaaaaaaagactgcttgcactgtcattgtaaggtaaatacagctacagacatacagatattttggtcaaagatagaccacaaatacaatggtggtgtcatgaggttataatatggtacttttactgtgccttttttgtgtttagatatgtttagacacacaaaaacttgccattgtgttaccattgcctgcagtacccagtacagtaacatgccgtacgggtgtgtagcctacgagcaataggccataccataaaagcctgggtgtgtcataggcaacaccatctgggtttgaagaagtctgctctaggatgttcgcacatcaagatcgcctgaccacacgtttctcacaatggattcctgtccttaggtgatgcatgactgtggtaggcaggtaggagtagaagcagaaaatgtaagtaaatccgtttgacactgtgcttgtgacctgcaacactcagtaactgccagtcatctttcataaactagaaacaagccagcttgtcatatttatttcaatacagaaagtcaaggccgtgggtattttgatctttctgtcttgatgctgcctcacctccctgttctgagtcaccagccctgtggattcttcctcctccaccctcacccgctttgtgtcctccacactgtccccaccctaagacctgatgaccgatagaaacacttgcatccttggcttaccttttttctttccccctttaaaaaatatcatagttttggctgggtgcagtggctcacgcctgtcattccagcactctgggaggccgaggcaggaggatcacttgcacccagaagtctgaggccagcctgggcaacatagtgagatcctgtctctatttttattttgtatttatttatttatttatttatttttgagacggagtctcactgtattgccaggctggagtgcagtggcatgatctcggctcattgcaacctctgcctcccggattcaaacaattctcctgcctcagcctcccgagtagctgggactacaggtgcacaccaccatgcccggctaatttttgtatttttagtggagacggggtttcaacatgttggccaggatggtctcaatctcttgacctcatgatgcacctgctgcagcctcccaaagtgctgggattacaggcgtgagccaccgcacctcgcctattttaattttttaaaaaaaatcatattttagtacctgtagtcccagctacttgggaggctgaggcaggagaattgcttgaatctgggaggcagaggtttcagtgagccaagatcacgccactgcactccagcctggcaatagagcgagactccatctcaaaaataaataaataaatacaaaataaaaatagagacagtgtgtcactatgttgcccaggctggcctcagactcctgggtgcaagtgatcctcctgcctcggcctcccaaagtgctggaatgacaggcgtgagccactgcacccagccaaaactatgatattttttaaagggggaaagaaaaaaggtaagccaaggatgcaagtgtttctatcggtcatcaggtcttagggtggggacagtgtggaggacacaaagcgggtgagggtggaggaggaagaatccatagggctggtgactcagaacagggaggtgaggcagcatcaagacagaaagatcaaaatacccacggccttgactttctgtattgaaataaatatgacaagctggtctgtttctagtttatgaaagatgactggcagtcactgagtgttgcaggtcacaagcacagtgtcaaagggatttacttacatttcaaatgacgtgtcatttgcagaaaaaaaatattaaaaatacaaataagcaaaaggaaaaacaatatccatgacccacaattgagaaataaccattatcgaaacaatatttcaatatgttactcctgtccttttttgtttcttggtttaaattttatttgtattgaggtcatacatgcacataagttgaagagtcaaattttctaaaaataggaatccccacttcactctctcctctcatttctgcctccccaaagataatcactttgagctgattttttgggtatttaactccatgtcttggaataacatgcttctatcgccacttcttagtttttctgttttcagtaaaatctgctttcccactctgggcaataagggttctgccctctttccctctcctcacctgcccagcccatgcagagacccttcccatcctttattctctcaatatagttatatggttattcttgtgagattgacatttacagtatacattattgtgactatgtaaatgccattcacagctgagctccgtggtaaactatgatgacctttacttttctccttttctgcaacttttcatttttcttttccttttttttttcttttgagatggagtcgccctctgtcgcccaggctggagtgcagtggtgcgatctaggctcaaggcaacctccacctcccaggttcaagtgattcttctgcctcagcctcccaagtagttgagattacaggtgtgtgccaccacgcccggccaaaactatgatttttttttaaagggagaaagaaaaaaagtaagccaaggaagcaagtgtttctatcggtcaccaagtcttagggtggggacagtggggaggacacaaggcaggtgagggtgaagaaggttttgaactcctgacctcgggtgatctacccacctcggcctcccaaagtgctgggattacagctgtgagtcaccatgcatggcctggaatctggatttttttcacaaactttctcagagaattacacctgactccactgaattctacaagcccagattttctatttttgcttagtaattctagtgcctgttacgtgctaagtggccagggccagattaaaatgttagcatccaaaggtattaaagaaattatgccccactcgttcccatgtataaatcaatatgaaatgataataaatagcaaaaatacatgaagagggctgggtgtggtggctcacgcctgtagtcccagcactacgggaggccaaggcgagcagatcacctgaggtcgggagttcgagaccagcctgaccaatgtggagaaaccccatctgtactaaaaatacaaaattagccgggtgtggtggcacatgcctgtaatcccagctactcgggaggctgaggcaggagaatcacttgaacccaggaggtggaggttgcagtgagccgagattgtgccattgcactccagcctgggcaacaagagtgaaactccgtctcaaaaaaagaaaaaaaaaaatacatgaggagaagtccaacagatcttatttttcctatggcgtggtgggtaggataatggccctccaaagatggccacgtgctaattgctggtccctgtgaatatgttacagggcaaggacgaattaagattgcagatggaaatagggtgctaatcagctgactttgagacgggcagattattctgattatgtaggtgggtccaatgtagtcagaagggtcctaataagagaaagaggggctgggcacagtggctcatgcctgtaatccaagcactttgggaggccaaggtgggtggatcacctgaggtcaggagttcaagaccagcctggccaacatggtgaaaccccatctctactaaaactacaaaaatgagctggtgtggtggcgggcacctgtaaccccatctacttgggaggctgagatgggaatcgcttgaaccccggaggcggaggttgtagtgagccgagatcatgccactgcacttgagcatgggcgacagagcaagactcagtctcaaaaaaaaaaaaaaggggggggtggaggggaagaggaagaggaagacaagagagtcagaatcagaagcagagcatggggtgaggcagtccttggctttaaaaatagcgagtggaccatgagacatgggatgcaagcagactctaggagctggaaaaggcaagaaagtttattctcccgtagggcctccagaatgaatgtgaccctgccaacaccttgattttagcccagtgaaaatctttatcttctaacctacagaactataagataattcatttgtgttgttttaagccaattccttgccataaagctcttaaaatatatccccttttggttctgcttctctgattgaatcctgactgatatacatggtaaccaatttgattccctgtttaataaaagcattaaagatcaaattcttagccaggcacagtggctcatgcctgttatcccagcactttgggaggctgaggcaggtggatcacttgaggtcaggagtttgagaccagcctggccaatatggcgaaaccccgtctctactaaaaatacaaaaattagctgggcatggtggcacacgcctgtaattccagctacttgggaggctgaagcaggaatcgcttgaacccaggaggcagaggttgcagtaagccgagatcgtgccactgcactccagcctgagtgacagagtgagactccatcttaaaatacaacaacaggccaggcctggtggctcatgcctgtaatcccagcacttggggaggccaaggcaggcggatcacgagatcaagagattgagaccatgctggccaacatggtgaaaccctatctccactaaaaatacaaaaattagcagggcatggtggcacatacctgtagtctcagctacttgggaggctgaggcaggagaattgcttgaacctgggaggtgcaggttgtaatgagccgagatcgtgccattgcactccagcctgggtgacagacactccatctcaaaaaaaaaaaaaaaaaaaaatccaaagaagaatggtatttcatgacatgtgaaagtaatgcaaaattcaaatttcagtatccataaagttttgttggaacacagctatgcctatttatattatttatgctgcatgcaaactacagagttgatttgttgctacagagatagtaaggcccacaaagccttcagtatttactgtctgactctttacagagactggtcagggagggcttccctgaggaggggacatttaagctgagacatgaataacaagaagactggagatagcgggcagagctgtctaggcagagacaatggagagcaaaggcagttttctctctaatcttgtaacagtcttctaaagagaagcgttattaaagaaaaaaagaaaaaaaaattgagggggccctgaggctctgagggtgctgtagcctctcagggtcacggagactgtaggtcctgaggaggggttgggaaccagcactgtctggcaccagaatttgtggtgccttatgctgcctccttctcggcctgacacagcattggagcccagaaactgcatgttgaatggctttattcaccttcctcggggaaggaccagggattttagattcattctcaggaataggtgagaagagccaaagactcacccatgggcatgagagaatgttctctgcagcctcatggttagtggtaggcccagaggaggccaagggcagtaggcaagacaacggatagagaagagtagtgaattccagctatgtggagtttccagcttggcgaattccagccatgtggggtttattggtgctggtagaaaatggtagcctcaagccctcagttgacaagtgtggccagagagaaccccactctcaatcctttgtagaccaggtcattcccgccaggctctgtgctaacggaggagagtaggttattagtcccatttaagagccagagaaattaaggcagtggagagtagcagggctactggtttaaaaacactggctctgtgcctgaatcccagccttgtcatttgctagctgtgggaccgcaggcaagtgccttgatttctctatgtctgtggataatgatggtatctacctcaaagctatgtaaagaattaaggaaacaatagcccaacaccacacctgcaggaaggaagcaagtttattattactcaataaacattggtggatcctgatgacattctctcagtcagctttagcagtcttaagagactgcagaggatggagaacccaaggttagagccagatttcttctctacccagttcctcggggccaaaaccctgacaccatgcttaactcctcttttatacgccatagtccgtcagcaaaccttgtcttcagtatgcgtccaggagtccaaccattcctgccacctccaccgtattactttcatccagactgccatcagctgtcacctagattattgcaaaagcctccttgctggctttggggcttccatcctctctctctcgccaatccccagtcaactcccaacaggcagcaaagcttaggttacttctcagttcaaaacccttctaggtgtgctagaattaactgatttatttactcaatgattatttattattgagtgtctactatgtgccaggtactgttgtaggcattgcagataaaatggagaacaaaacagacaaaaatttctgcattcatgaagcttccgttctcatggagggagatggttaacaaacaagtgtatgagtaaaacatatggtaggttaggtgtcatgtggaaaaatagtttagggaaggcggggggccttggattttaagtagggtggtcaaggaggtctaacacacaagataagggttaaataaaaggccaaacgtaggagaggtgggagccaaagagctacccagaagaagagcattctagataaaggctcagtaagtgcaacggtggaagtattcctggtgagtctgggacaatagtggaaagtcaaagtgtgtgggaggggagatatagagccccatgcccccctcccacacacttcagaggggaaaagggggcaggattgagtcctgtacattccccacgttttttttttctctggagattggaagccattggagggtctaagcagaggagtgatgagttaagctgctgtgtggaagtccgtaaggaacaggggtgagtcagagaccctgaatggagccgttgcaattatccagatgagatagagtgccttggatcaggaagggaggtagcaacagaagcggccaataaagttcaaagtcctcagccccagtcctcccgatgggggtctcacctacccctctcacctcaccttgttcctccctgcatccccaccccaccggtcactgctaggcacatagaagcatctactaagcatgtggtgaatcaatgaaccccttaatgaatggtccacccctagatcatcagcatcctttttaacgctaggcatatagtctgaactcaacacatgtttacagatggaatgctgcacagtcctgccaagtccaggcggttattcctctccacagccgaaggaaactaaggctcgggtggggaagtgtccccctggggtctctccgcttaggctgcaggctgggcatcctttttcaaactcttttagcacagcgaagtcgagggcactgggtggagggtgcttgcttgccctcagggtgagtcacagtgacctcagaggagtttccccaaaacgtccccgccctgtgatggggaaaagccggaatctctcggtcccaggtggtcatgtggcccaggccggacaagcgtcccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagtgagtgggctttttcccgggcggcggaggcggcggggctgggccccggcgggtgacagcgagcgcctcaggccgccctccggccccggaaggcggagcttcttttgctggttggccaggactgaccaagccggtgcctacgaggagggcgggatgggcgggcctgggcccaggtgggccttgctttcccctggagatcggtccctcgagctgggaatctactgcccagcgcaggcccggagagctgtcttgcggaaaatacaaaccatatttactttcccagttttcggtaatctcatggttactgagccctcttccgcctcctccaggaagtcgtccgggttctccacacccacctcctacgtagccagtcgcctcctgtataacgatcagttttcatgtctttctccttcactaagtttcatttagtcattaactgttagccatctactcaattccaggccctgggcaggtggtaggaaaggaggccgaccaggagccgctctctgggagcttccattctagtgggaaaagaagaccataattagtcaaggtggtttcagatcgtgattaattaacgttatttgtgcctagtgttccattattggaacgctaagcatgtgggagttatttatatcctactgctcaaggtcatcgccaaggtctgatttttctcacgtctgcagttctaaaaattgcaacctctggcatgaatgggttaagtgttctgaaggaagcaaaatagagttaaggttggggagtccactcaggaaaaagtgacattcagcagaaacttgaatgaccagaatgagggataggagaaataacatcaggttcaaaaggcctggctcaagaaagagtttagtgcttttgagtgacaggcagcatggctggtgtgtagagaggaagggggttagctggacaaggggagatggggaaggacgggctgtgtcctccaggtacttttgggcaagtccaaaagtcatctccatacctgcagggcagagtctgttgcagattgtagatgccctatcactgtttgtggaatgagtatgtgaagatgaataaggaaccccttcattgatactggagtccttcacctgataacttttcaaatatatttcttggccatgtgggggtcatttcatgtaatcagttatttattgagcagctgctccatcccagacactaaacagcctcagcagcacaaaataaaagaggcaatatagcccagcgatttcaagtttgggttttcagcttgattctgccactaactgagatgttggtgaagttttgcaacctccctgagccttagttatgcatgagtaaaaaacggaaagtaatcatacccaatcagacatgttatacctattaaatgagaggtagtgtgttacctagttcctggaataaagcagtgctcagaaaataataacttttgtagtcacagtaacagttattatagcaatattgtactagttcacaatcccagcacagtgtgaaagagctgtgggaacatacgcagtggagtgggtaaattcgggtgtggtaagatggggtaataggaggtgacatttgagccgtttgaaatctgagagggattttgtaaagtagggtagggcatgcccagatcaacaactgggcaaattgaggtggcttcttcaacttgcagaaataatgccaggaaaataatgtaaattggagaaacaaaggtgctaagtaaacagtgttggaccttggaaagtgatgagactccagtttgcctccctttaaatcccccagtatttgccaaagagcaggcagcatttcatttctatactagctctgattccctaccgttcttgtcctctaagtggctgtattcaaaagcaccagaggccactggtacccttgtgctgtgcaggcagggattttcttagtaagtttctctcgaaggcctgcctgttaaagacttctgaatcccataaagttcttggacagcttctctttctggtgtgaggtgtgtgaattgatgttttgggacccttttccattatctaattatgctttctatgtcctccaggaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctaggtgaatatggacactgtcatccccatcatctgccatcccgtgtctgtgtgctcggtctgtgtgtttaaccctgtcactcctcttgactgtcaagtcttcctcccatttggttttcatatcaaacactgagggaacatgatcagtttataacatcattaacaggaaactctcttctttataaaatcatggtgcttagcaagttctgaagagctgttgatgtaatatcttggcctttgaaagaaggattaaaaaaattttggcctagaaagaatcttgaggcctggcgcggtggctcaagcctgacatctcagcactttgggagacttgggtggatcacttgaggttaggagttcaagaccagcctggccaacatggtgaaactctgtcttcactaaaaatacaaaaattagctaggcgtagtggtgtatgcctgtaatcacagctactcaggaggctgaggcacgagaatcacttgaacctgagaggcagaggttgcagtgagccgagatcacgccgctgcactccagcctggatgacagagtaagactgtctggaaaaaaaaaaaagaatcttgaacatctagtttaatggatttcaagttctactcaaaggagtatgcacctgtgcaggggatgaaggagcagggggtggggtggcaggaggtgggaggagtcagatgggagaatatctgaccccctgctcctggcttcaatcagagcagcattttgtgttcatatttatttgacttccatgtgaattttatttaatggttttgctgctgattgaaagagcagaaacccttgccccagcaccctgttttccttaacctctgtcattctcattaaccatggtcatgacttttgccatatctatgtaccacctgtattgttaatttagttatgtactatttttgattaaatgcattcactctctgaaaacctcattttgggccgagtttggtggctcatgctggtaataccaacactttgggaggccaaggcagatggatcacttgaggtcaggagttccagaccagcctggccaacatggtgaaaccctgtctctactgaaattacaaaaattagctgggcgtggtggtatgtgcctgtaatccccgctactcaggaggctgaggcaggagaattgcttgaacctgggaggcggaggctgcggtgagccaagatcgtgccactgtactgtagcctgggcgacagagtgagacactgtcttaaaaaaaaaaaacaaaaaaaaccaaaaaactaattttgttcaaccttctcttttagtgtgtgaggaaatttcagcatagagaagtcaggtggttgtcataccaggctgatataagactagagactgataaccaggttaccagataccagtcgagaggtttagataaaagacaaaaacttaaatgcctcccagtgtgcctccatctcaaaaaacaaacaaacaaacagacaaaaaagaaatccagttgaaactacacaaccacttttgattagctaaggaataaatagctttgagtttgacccaagttcaaattcttttttttttcttgagatggagtcttgctctgtcgcccaggctggagtgcagtggcattatctcggctcactgcaagctctgcctcccgggttcacgccgttctcctgcctcagcctcccaagtagctgggactacaggtgcctgccaccatgcccagctaattttttgtatttttagtagagttggcatttcattctgttggccaggatggtctcaatctcctgacctcgtgatccacctgcctcggcctcccaaagtgctgggattacaggcgtgagccaccacgcccagccaagtccaaattcttgtttggccgggcgccgtggctcacacctataatcccagcactttcgcgtggatcatctaaggtcaggagttcgagaccagcctggccaacacgatgactccatctctactaaaaatacaaaaaattttagccagacgtggtggcgggcacctgtaatctcagctactcgggaggctgaagcaggagaatcacttgaacccgggaggcagaggttgcagtaagccgagatcgcgccactgcactccagcctgagtgacaagagggaaactccataccccacccccccaaaaaaacaaaaacaaattcttgtttgaaagtgaaacaagcatttcatttgctgcttttctttaatgataccaaagtcatactcctaatgagattaggtcttttcagaaagttaaaaggtgcaactgtttttttttttttttttatttctctgatgtgtattaggactgtttattaaggaaaagtataacttctcttacatttatattctgtctctggtgagtggacaaagaattttaataatacacttgaggccagcgatttgagaccagcctgggcaacatagtgagactctgtctccacaaaaaataaaagattttaataatacggtctttttatttgaaatcctaggactcatccttgtctgtcatagttttagaaacttataaaccgatactgaaaaagtacacagaccagaagtatacaatgtctcatatagatttaatacaccctggtaattttttaccctgtaaatgtagttgaattctatttctaggggattacttcaacaatgaaggactctcttttgttttattttctttttcttttgtgatagtagtcgaagacaaagaagaaaagcatttcttttcttgattaagaaatctttagtagctgaagtcttccttcaggattaaggagtattattaatctatttacactgctgtcaatttgatatgttagacaatataaaaggcgggcctggaaaaaaaaaacttttgtaatcactttttttttaagggaaattgaaaagtataatatgacttttaaagtaacttccagggcgtggagcatttaagattagctgaacaaaagaccacaaaacaggtttctataatgtactttttaaaccaggcaaaatcctgcccagtgttaatacatctttggggccagaaaggctgaacttgctgtatatttctcttggattgccctctccaaacagattataaacctagactctagagtcacaccaatgttagatggctttcattttcacctaatcagattcttgatagtttatgagttagtgtctctgcttatgtggaggttagcatgtattaccaaaacagaatgatgctttctttttaagtaaatttaaggcattgtttgcctgttgcatgttattttatttctgattagatatccaaacattgaatttttttttttttttttttttttccccctgagatggaatcttgttctgttgcccaggctggagtgcagtggcatgatctcacctcactgcaacttctgcctcccgggttcaagtgattctcctgcctcagcctcccaagtagctggggttacaggtgcctgccaccacacccagctaatttttgtatttttagtagagatggggtttcgccatgttggccaggctagtcttgaactcttgacctcagatgatccacctgcctcagcctcccaaagtgctgggattataggcatgagccaccacacccagttcaaacaatgtaaatctgatggtgttttaaaaattgctgttattaggtaacttgctaattcatgaataaatgaactcaagtgaattaagggaaattagcccatagtttattctagacctcagaactcctgacctggaattcatttgccactttttgttactcttttagttaattcaaatgaaatggtaacttttgtgtcctgtaagcacatgacaggattacagtgtgttcctctttgttgagaagggatgacaaaactctgtagttacttttgatttttagaagcttgaaatcagttgacttgcatttaaccgttgttgatctttgactccacaagaaaaaatggggaatcattgttatttacttacactagattaacaattaacattatttgacacatacattttatgggccttgaaacttaatggagttattatgattgatatgtgttttatatattttccatagtcattactccaggcatgaaaaattgaaagcacaccctccataccacacagaagtgtttgccctttcttgctcggtttttttccaagtgtacttgaaaacgtgcttgtttttgcatatacagatgtatattcgtaagtacatgcagaaacacaaataatacatgtttggagttgcaaatttgttttgacataaatggggtcccataacttgccttttcatctcacagaatgtcttggagatcattgtattggtgttttttctgtctacctcattcttttttttttgtagtaaatacataacatacatttacaattttaaccactttaaaatgtacagttcagcagcatctagtacattcacaatgttgtgcagctatcactactatctagtttcagaacattttcatcaccccaaaagaaaaccattaaaagcagtcattccccatccctcccttttctagtccttggcaaccactattctgctttctgtctctaggaatttgcctatttagaatatttcatataaatgaaaccatataatacgtggccttttgtgtctggtttctattacttagcataatgttctcaagattcatgttatagcatatgttagaattgcattcctttttatggctgagtaatattccactgtatggatatgccacatgatgtttattcattcatcagtgaacatttggattgtttctaccttttggctgttgtgaatactgctgctgtgaacatttgtgtataggcttttgtgtggataaatgtttttatttcttttggatatatacctgcaagtggaattgccgagtcaaacggttactgtatgtttaactttctcagaaactgacaaatgttttccacaggggctgcaccattttacaagggttccggtttctccatgttcttgcgaacacttgttttctggttttaaaaaaatgatagactgggcgtggtggctcatacctgcaatctcagcactttgggaggctgaggcgggaagatcacttgaggccaggagttcgagaccagcctggcaatatggcgaaaccctgtctctcctaaaaatacaaaaaaattagctgggtgtgggcgtggtggcatacacctataatcccagctattcgggaggctgaggcactagaatcatttgaacctgggaggtggaggtttcagtgagctgagattgcaccactgcactccagcctgggtgacagagtgagactctgtctcggggaaaaaaaaaattatagctatcctagtggatatgaaattgtatttttgttttgttttgttttttttgagatggaatcttgctctgtctcccaggctagagtgcagtggcatgatcttggctcactgcaacctctacctcctgggttcaagtgattctcctgtctcagcctcccatatagctgggattcaggtgcgcaccaccacaccctgctaatttttgtatttttagtagagacggcgtttcaccatgttggccaggctggtcttgaactccgacctcaggtgatctgcttgcctcagcctcccaaagtgctgggattccaggtgtgagccaccgcaccaggccctcactgtattttttaaaaaatcttacatgtccttccagtgaatcattgtattttgattttagtttcccttgtgactattgatgttgaacatcttttgtctattcatgtcctatgcccgtttaaaagctgtggtgtttgtctcttggctgttgagtttaagagttctttatatattgtggatagtacacctttatcagatatatgatttgcaaatattttctccccttctatggattgtcttttctgactttattctttttaatggctgaaggctgttacctggcattgatgagccttatattaactctttctgttaatagtttccccttttgctcttaaagccgcaaagagttgtttgatctatttatgagaataacttaaatttttaaaaatctagcttggtacaaaggaagagcagaaactggttcaactctcttggtctattttctgtccacttatgtgcttatttgccgttttttgttttgtctagacattgggcatgttcattagtcacatgttatgtttatgcactggaacttttttcttgccattagtatttaatgtaggatttctaactaggttaaatatttatataaaaataacaccacagattgatagtttaaagcacagaatgaaaagaggacaaaatgtctacatttacaacactctggccacctggtgttttttggtgggattaaagaaacctaatttgtcagtgcagcctctgagggtgaccagttaacaggcatgtggattgtttaaacatttccttgaaaaaaataacaaaattaatgttagtcctgttaatactgtggttgatgagctggtataccatctaggtgcccagtaaaagaaagacatgcacgctaacatttggattaggaaattacattcaggaataatttttgtgaagtacccattttttttgccggggggttggtgggggcagaaatatccctttcaaatcgttttattttacatcttcttattttctttcataacaacacctctgtgaggaaagttagacattattctgttttggagattgaggaatgaaggcatccagccaagtgggaggtggtggggtatgctgtggttaagagcacagatttggaatctgactcaatactgcagcacctaccagtggtgtgacaggggctgtgatgtctagaagcctcagttttctgatttgtaatcagagaagatagtggtaatgacagctaattccgagggaagttggaggattaaatgagagagtatttggggtgttcagcctagttcatggctcatgggaagtcctcagccgatgggaatggcaggacacagctgcacccagctggggagcaggagtgttccatattcagatctctgatgttcttgtcaccaaaccatttactttttcctgtttgtaaaacccttacttccctctatgttaagagccagtcacatgatggcaaaataatttgtgtcaatgcaatctgttgcagttacatttatgtaaaagtgattgatttcattgacttcctcttcaccatatagtgttccagttgataatcacttccaaaaagttgaagaccatttctcagaatcagaaaaatttgaataattttaaataattttataaggtttaacagcttatataaaaaaataggtttctggctgatcaccgtggctcacgcctgtaatcccagcactttgggaggccaaggtgagtggattgcttgagcccaagagttggagaccagcctgtgcaatgtggcgaaaccccatctctactaaaaatacaaaaaaattagttgggtgtggtgtcatgtgtctctagtcccagctacttgggaggctgagatgggagaatcacctgagcctgggaagttgagactgcagtgaccctagatcataccactgcactctagcctggatgacacagtgagaccctgtctcaaaaaagttagatttctgttcctcttccaataactactgggaaacaaactagttcaggcagacaaagaagtatagagaaaatataataaacattgtaaatgtacctccagtttaagaaatgagacacgaaaaacaccgctgaagttcactgtgttattccaattgtccatttctgtgaggacccccccagaaataaccactgacttgaacttggtgtttatcattcagaattgagtgttttttttaaaacattgtattatttttttttccacagctatctgcatcatattggtgcatttactgatccgatacagattacatttcttgccagagagtgttgctgttgtttctttaggtaagtgtgtattggtgattccataataaaagcagtaacaataactaccattttttgagtgcctctttagtgccaggaaccacaagagatgcatcacatccctgatctcatttgatcctcactgcaacctgccctaagggtgctatgatcccattttacagatgaggacactggggctcaagaagggtagtgacctcctaaaggtcatgtagaagcccaaaggccatacagctctgtacagctcaaaggccctttcttagccttttgcttctggtagaactacccttggggaacattgacctctactgctaggctaggctgacatccaactcaactaaggtaagtaatgacacttcatagaatcactcaattttatagacagaagggactctgactttacagtttaggaggaagaaatggctcacttaatgccagagtcaggtctaaagtcttcagagagcattgtgctctaccccacttacatttctgttttgtttcctgtgccaattaactgttgagatctagttgcagtgaatgaacccgtgtaataacaggtgtgaatgcacacacaagttcattgaagtggttagtgaaggaagaagtggggaatttccgtaagtgtaagttcaaggctaaaatgtgggtggagacatgtaaggcacagtaaataaagtcttactaaggtcagccaaagctttttatcagtttattatattgcagtcacttttactagtttctacttgcctactgatggtatttaatttttcctgatcactgctgatgtttagaaattaactttcattgcctggtagatctttagtggagtagtaattctttcacaagatagttattgtttagattagctttggaaatgattgtttagactctgttcactagcctccccctcctcccatcaccccagcagtcctactaccttggttcagactctcctgtattttccctggacttcagtactaagtgccagatcctggcttgtgaggcttcacattgtcatctatctcatttatgccttatgacctccaggtgatgccgtattttaaggaatgggcaccactggatagtgttgacctcgagtacaggtttcaaaaccagttttactcaaaaagttcttgttctgtttttagcatgttttttagcaatatatcttggtagattctaacaaccttagctagtaagatagtcatagagctctaagaataggagccttgctcattaacattcctttctgctattaggcatattgaaaagaacctatgtgactaatacccataattctgggacattcggtaaaggctctaagaactactccaaggaatttacagttgtgtggtcagttttatagcttcttacataaatttgttatcaaaattatagttggtgtgtatttagatattatacacatgaaaattaaaatgataattcttataatttcatttggaatttcaagctcctcatgtttcttgaatgtctgggtaactgcagcttgctgaacaccagtgcttctattaggacttagagcagacattgttggtggcttaccaaagagtcatttcccccttcttccttgaaaatagaaccccaaatttgatcaggtatcttgccacagtgtgctcaaggaagatgggcccctccaagtcaagattggtctttgccatcatgttaatttcactcttctctgccaatgattagttcagaggggtaggggcggcaaggcagtgtgaaacccagttctggccagtgacaccaaggggaagcgtgatgaggtagtgggtcctggaaaatgttttcctctcagatagtaatgagacatttccccttcatttctttgatgctgctgaatgagagtgtgatgcctagtggactggtagccatcttgcaactactgtggctcaaagacaaaagccagaatgctaaggattgccgaggggacagatgggaatcccagattattgatagcattgttgctttgttgagttgatagccctgaaacttcctatcttagtgctaccttttatatgagataataaacatctattagctgttgttgacttggaataaagaaaaaaaaccaaaaccaacatctattgtttaagccatttttagtctaggttcttttacttgcaactaaaagcatcttaactaacatagaactctttccattcaagggacaaaacccaattcaaaagaaaataaattggccaggcgcggtggcttatgcctgtaattctagcactttgggaggctgaggtgggtggatcgcctcaggccaggagttcaagaccagcctggccaacatggtgaaacccctgtctctactaaaaatagaaaaattagctgggcatggtggcaggtgcttgtaatcccagctactctggaggctgaagcaatagaaccacttgagtccaggaggcggaagttgcattgagctccagtcaacgccagggcactccagcctgggtgacagagcaagactctgtctcaaaacaaacaaacaaaaaaaattggtgggggtaggggcgctcacctcttgactcatgtaactggcaaaactacaggtagtattagcttgagacttagctgaatcaggtctcctggacccagttcttctccatgcctcagcagtgaatcccttttccccggcttcgctgtcaggcaggctctctccctgtggtactctgatccgttctcagacaggctcttggtgtggtaagcccttaaagcagtaactgcagtgggagagagaacctcctcttctttctggcaccaaaagttgcaggatgaactctgaccacctggcgacctcaactgggagtggggtggaatggtgttgggagtcagccagagctctccatctacaaggttcatttcttcactgatgttgcagaaataattgtagcctgaatagctaggtcttgggagaagtgatggaaaggcagtcttgctttcaatgcttacttgctaactcaggtgactggaaacccaagagcacttccagggagagtgctgaggtccagaaagtactttttaaaaattatgttagaggacatttggttagaatttgtaaatgctgacatagctatcaaagtaattctgtatttcataaagctaaagaaatggaaggaaaacgtttttctccagctggagcaaagtgtaacaaaatattgagatatctaccatttcaagaatttccaactttgtgccaaaaaagaatctagaagaagttgccagagaaagtatggttttcgttctttcagggataaattttcctctcctgccagaagttgctttgtagcttgcagtcatttcgagacattactggtcttttgctttatagttaggtgttcagcattcctaagaaattctcagtatagaaaaggaccatctgcactccaaaagcacatgtcccctccttctaccttactgtatttttaaatgagtgtctgtctggccacttttcattctttataaaaatatagtatcaacctgaagttctaaagagttccttggcccctgttcgaagctttcaggatactttccatactttatggaattctgtagtttgggccttttaaaaactaatttcttttgcacagttaaacaactactatatatagaaaaaagaaaaatcttgtttattgacaattatttttatcttgtttcattctcttccagtccatgtgtagacatgtccgtatgtattagatgcctttgtatagtttaatttgagtttatatcattttttctgttctttccatgtattagttgagttcacatatttatttatttatcttttttttttcagacagagtctccttctttcacccaggctggagtgcaatcacgatcttggcgcactgcaacctccgccccctgggttcaagcgattctcctgcctcagcctcctgagtagctgggattacaggcacataccaccatgcctggctaatttttgtatttttagtggagacagggtttcaccatgtcggccaggctggtctcgaactcctgaccgcaagtgatctgcctgcctcggcttcccaaagtgctgggattacaggcatgaaccactgtgcccggcccatatttatttttttactggctgtgtaatgctgattcatgtatatattttaggctaaaatttgtaaggaatgaaaatgaggctgggtgcagtggctcatgcctgtaatcccagcactttgggaggccgaggcgggcagatcacctgaggtcaagagttcgagaacaacctggccaacatggcgaaaccccatctctactaaaaataacaaaaattagtcaggcatggtggtgcacgcctatagtcccagctattcaggaggatggggcaggagaatcacttgaacttgggaggcagaggttgcagtgagctgagatcgtgccactgcattccagcctgggcaacagatagagactgcatctcgaaaaaaaaaaaaaaagaaaaagaaaatgaaatacttgtaagcgtatggccagcatcctctgttgaataataccaaagacaggagtttcccccaaccccaaaaatcatgctttattttagagtgagaaaaggccagattagggttataagtggagggctgaaagtttgactttcagttgccaaagtttagccttaatactgctgatgattagaaaaactgtgatctaacttacaaactagatttgattgaatcattgggtaaatagaatatacaaaagtgctcccctgtcataactttttaaaccatatttgtgctatttaattctattccttcttgttttctactaaaagattttaatttttttgttttttaaggatagtacttttggccagttacagctcttttagaatttgtcgagcaggctttccagtttttgttggaaagcccccgtacccccaccaaaaaaaaattttttttttttttttttttttttgagatagagtttcacttttgccgcccaggctggagtgcaatggcacgatctcggctcactgcaacctccgtctcccgggttcaagtgattctcctgcctcagcctcccgagtagctgggattataggtgcctgccaccacgcccagctaattttttgtatttttagtagaaacagggtttcaccatgttagccaggctggtcttgaactcctgacatcaggtaatccgcctgcctcggcctcccaaaatgctgggattacaggcgtgagctaatgcaccccgcctaattttatatatatattttttagtagagacggggtttcttcatgttggtcaggctggtcttgaactcccgacctcaggtgatccaccaccttggtctcccaaagtgttggaattacagccgtgagccactgtgcctggccaaaaaattgtttttaattaaaaaaaaaaaaaagggcctggcacagtggctcatgcctgtaatcccagcactttgggaggccgaggtggccggatcaccttgaggtcaggagtttgaaaccagcctggccaacatggcaaaacctcatctctattaaaaatacaaaaattacccaagcatggtggcatatatctgtaatcccagctactcaggaggctgaggcaggagaatcactttactccggtagacggaggttgcagtgagccaagattgtgccactgcactccagcctgggtgacagagtgagactctgtctcaaataaatagtaataataataataataataatgtattaatatattttacacattagcacagtgcatggcacacagtatagatgtgtgtgtgtgtgtatgtatgcatttatttctttttaacacagtgcaaatacataggtgtgtgtgtatgtgtgtatatatagatttttttttttttttgagagagagagaacttgtgctgggattctacactttgtaacctgattattaatacatttgaggatgttttcggtggcccatgcgtcggggatggttggatagtaagatgggggctgtgagttcgctgctcagcaacttgatgtgggggaaactcggctggtatcctccttcaccaggaaagatcgttaatccaccgaaggacttgaagaaacctcatggggctgggcgcggtggctcacgcctgtgatcacagcactttgggaggccaaggtgggcggatcacgaggtcaggagattgagaccatcctggctaacatggtgaaatcccgtctatactaaaaatacaaaaaaaaaaaattagccaggcgtggtggcgggcgtctagtcctagctcctcaggaggctgaggcaggagaatagcatgaacccgggaggtggagcttgcagtgagccgagatcgcaccactgcactccaacctgggcaacagagtgagactccatctcaaaaaaaaaaaagaacctcatggaaagaaatgcttctttgtgaaatttttttggaacataagatcatgcctggattaaagtgaaacagctgaagccatatcatgctcataaagaggaaatgataaagattcacaagggtaaactattccagcaagcggtggatgccgccaaagagtttctcaggagagcccaaagggaaagatcagacgtcatcccacaattctgctgatgacaagaatcggcttaattccagtgaggagagaagcaggccaaactcaggtgatgagaagtgcaaacagcctgtctgaaggaaaagtgaagaagatcatgggagatggaaagaagggggtgtcttcgggctcttcagagacaggctccaaatcccctctgaaaagaatccaagagcaaagtccccagaagcggggtcagcccccaaagaatgagaagaatgtcaccatcgtggagtccggtaccttgaagtggatgatggccggaccagtggctgcatttaaatggcagccgaccagaagcgagcctgttaaagatgcagatcctcatttccatcatttcctgctaagccaaacaagccatctctgtctgttaccaggcaatcacaaagaagttgaaaatatgtgaagaggaaactggttccacctccatccgggcagctgacagcacggccgtgaatggcagcatcacagacaaaaagatgggatttgggggccttggtctcatgagaagtggaatcgtctctaacttgctaaaaatgggtcacacagtgactgtctggaaccgcactgccaagaaacgtgatttgttcatctaggagggggcccgcctgggaagaacccctgctgaagtcctctcaacctgtgacatcactttcgcccgtgtgttggatcccaaggcggccaaggacctggtgctgggccccagtggtatgctgcaagggatctgccctggaaagtgctacgtggacatgtcaacggtggacgctgacatagtcacttagctggcctgggtgattgcgtccaggtcggggggtcgctttccagaagctcccatctcagggaatcagcagctttctaatcacagaatgttggtgatcttagcagctggagacaggggcctataggaggactgcagcagctgcttccaggcgatagggaagacctcctccttcctaggtgaagttggcaacgcagccaagatgatgctgattgtaaacatagtccaagggagcttcatagccatgatcactgaggtgctgaccctggcctaggtgacagatcaggcccagcagacactcttggacatcctcaatcagggacagttggccagcatcttcctagaccagaagtgccaaaataccctgcaaggaaactttaagcctgatttctactgaaatacatgcagaaggatctctgcttagccattgcgctgggcaatgcggtcaactctctgactcccatggcagctgcagccaaccaggtgtacaaaagagccaaggcactggaccagtccaacaatatgtccgctgtgtcctgagcctgcatacactaagccgtcggaccccccacccccagccctctaatctctccgctaactccctcttcctcacatggggtcaggggcctgggactttgctctggaccagcccacctgtctccatttccttttacacagactttgagacttgccatcagcacagcacacagcagcacccttcctttgaggctggtatggaggggatgagtgtcagcaggattggctcatgggaaagctcttgagctgggcactggcctccacacgaggaggtggctgtgtgtgcacgcacacacacgaggaggtggctgtgtacacacacaaacacacacacactctctctctctctctctctctctctctctgtctctctctctctcaccccaggatagaaactgcccagaaacagctgcctggctttttttcttcttccaagcttgtcttatctcaaaccccttccagtcaaggaactagaatcagcaatgagagttggaagccttcccacagcttccccaagagcgaagaggctatagtcatgtccacgtcccccgctgaattctctgcagggagaggacttgggcccagatgagccagaccagactccagacagagggtcccgtggggcccccaaactcaggtgatgagctgagaaagagaaagatgttcatgtctaagtgtccagtgtgcacctagcactccttagacgcctttgtgaactgaaaagagactggcagagtcctgcgaaaatgaggccctggctttccagggagtatggtgagcatctggccttcgctgcctggaagtgacaccccagacaccactgccacagtgggcgcttgccccgccctgggctgttctagtatttggatttgcattccagtccttgggagggggtcctcagggtcattagtgaggagccaagaggagtggggttgggggacactccttcctgtttctgttaggccacagactcttcacctgcctctgaagagctgctctgaccttggtctcctccccgcagtcccacattctccagcctgccctgccaagccccttgcatgcccactgctctctgtcctcccttctccccaccttcctctcatggagacagtatttctttctgtctgtctgtcccttctttggcccagacccagcctgaccaacgataagcatttcttaggctcagctcttgatatggaaatgagtgtcttcactccagccagcatcatggtcttcggtgcttccaggcctggggtctgtcgggggtgaaaagaactggcctgacctacctgaactgactgaccctctggggtgggtctgggacatcctcgaggccctagcatttctccttggataggggaccagagggcgcttgggatgttgcataagaacaggaagtcacccaagggatgtcaatttcttatccctctacatgggttggattttccaaaatcataatttgcagaagaccagcacttatggtggaatgtatattataaggcagccacactggggcagggtccttcccctctccccactcacggctttggccctttcacagattagaacctgagttagaggattgcagaagacgaggtgggagggcagggaagatgcctgtcaggtttttagcacagtttatttcactgggattttgaaacatttctgtttgaacacaaagcctgttctagtcttggcaggacacattctgggggtgggggtggaggaagatgtggtaatgtaaccggttagtcagtgttgtcttaatattgttgacaattctgtaaagttcctttttataaatatttgttaagctgtttcacctttgttttgaaatcctttcctttttttttttggagacagagtctcactctatcacccaggctggagtgcaatggcatggtctcagctcactgcaaccttcccctcccgggtccaagcgattctcccacctcagcctcccaagtagctgggactacaggcacgtgccaccacactccgctaatttttgtatttttagcggagacggggtttcactatgttggccaggctggtctcgaactcctgacctcgtgatccgcccaccttggcctctgaaagtgctgggattacaggtgtgagccgccatgcctagcgtgtccttcccttttaagcagaaaatgtgacacttgtgaaaaagcttgtaagacagcacttccctttttttccctttaaacctttaaatggcaaatctaggtaattaaagttgtgaatttttatttttgctttgtttttaatgaacacttgtctttcagaataggattgtgtgataatgtctaaatggcaaaaacaaaacgtgattttgcacaattaacaaaactactgcaagaaaaataaaacatttcttggtaacaaaaaaaattaatacatttgaaacatttttcatgtaaccttactgaccaggaatacttatattttacagtcataatggtagccctgcagtgcactctgggagtgagcgagcgagcattggcagttcattgtagtagtgtaggcagcctgcagtagtgcagtctcctgtgtctttagcatgatgagatggtaggatgcacccgagccaacgggccagcatccttactggccctaagctctcagaaaagcttcttaaactctctgagcttccctacagtgttcttttgaggattagaagtaattgaaagtgacaaatcctgaaagaagcagctcaacaaataatcattaattgctcctgatcctctgaatgaattgaggggtgtccttaattaggtgtatgcacaaagatcaactaggagcaaaggaaaatgttagaacttgtgtttctatttatttttaacctcactcttttacaatttctatttttttgtgaatatttttaaatataagctgggcgcagtggctcacgcctgtaatcccagcactttgggaggctgagacaggcggatcacctgaggttgggagttcaagaccagcttggccaacatggtgaaactctgtctctgctaaaaatacaaaaattagccgggcgtggtggtgcacgcttgtaatattagcttgtctctctctctctctctctctctctctctctctctctctctctctctatatatatatatatatatatatatatatacacacacacactatgtatatacacacactgtatatacgcactatatgcactatatatacacacagtatatgtatatacacacactatatatacagtgtgtatatatatatatactgtgtatatatatatatactgtatatatatatatactgtgtatatatatatatactgtgtatatatatatactgtgtatatatatatactgtatatatatactgtatatatatatatatactgtatatatatatactgtgtatatatatatatactgtatatatacacacacacactatatatatgccatatataatatctggtggccagttgtgtgaaatacattcattttctctgttgggtagattgatttgacctaactatgagcctcaatctcaagaggtaaagtggtagtttgccaatttaatgctgcacaaaggattatttaagtaataataacaataatatcacattgtattttacagcgcttcctagtacatcataaataataaaaagacgcaggcttgggcaatagaataattactgattttcaaatgtaactgcttcatgtgtgattataaacgaggtaatcatggcattaaggtttggtatacatttagaagggaaaaagaaagttgaggttttagtaaagcagaaaaacactaagctttaaaaatgaagcctgaaaccatggaaagaggtttaacttccctagtaatcaggatgattgctgaatgcaaattgaatcaaatacaaattgaaacattaaagtacaatttcttgcccactatgttggcagaaatgttaacatctgatgattatccagcgcgactgaggatgtgggacgctttcttgtggaagtgtaagtcggtacaaccactttggaggataatttggcaatattttcagagttaaaaatgcttatgctttgtaaacctgccatttgtagtctctggatctgccctagggagatagtctgggtttgtttttttttttgtgaatgtcttccacagggagatactcttaacacagagtggcatgtacaagcatgttcaatgcagcaccactgttaatagcaaacagctggaggcaaccatcagtggggcaatggttcaaaaggttgtgattttaaaaaaaaggtacaatataattcacatatcataaatttcaccatcttaaagtgcacaattcagagttttttagtatattcacagagttgtactaccatcacctctacctaattccagaacattttcattaccccaaaaagaaactcatacccattagcagtcactccccatttccacatttctcccttctcccatcccctggaaaccaccaatctactttctgtctgtgaatttgcctgtcctggacatttcgtataaagaaatagaatcatacaatcggtggtactttttatttggcaacagctttattgagatgtactttgtatgccacacaattcacttttttttttttttttttttttttgagatggagtcttgctctatcacccaggctggagtgcagtgctacaatctcagcttactgcaacctccgcctcctgggttcaagcgattttcctgcctcagcctccccagtagctgtaattacaggtgcccgccatcacgcccaactgctttttttgtatttttagtagagacggggtttcactatgttgaccaggctggtcttgaactcctgacctcagcctcccaaagtgctgggattacaggcatgagccaccatgcccagccaattcacccattttaaatgtacaacaatttttagtatgttcagagtcgtgcagccatcaccacagtcaattttaggacatttttatcacctcaaaaagaaaccacatgccctttagctctcctccctgtccctgggcaaccattactgtccctgtagatttgtctattgtggacatttcatataaatggaatggtaaaatatatggtcttttgtgtctggcttctttcacttggtgtattttcaagattcttccatgttctggcaggtaccagtacttcattccttttcattgctgaataatattacattgtatggatataccacattttgtttactcactcattagttgatagacatttgggttcttcccactttttttttgaaatggagtctaactttgtcacccaggccggagtgcagtggcgcaatctcggcctactgcaaccgccgcctcccaggttccagcgattctcctgcctctcccaagtagctgggactgcaggtgcataccaccatgcgcagataatttttgtatttttagtagagacggggtttcaccatgttgttcaggctggtcttgaactgacctcaagcagtccacccacctgcgcctcccaaagtgctgggattacaggtgtgagccaccacacctggcctctttccaccctgtgactgtttgaaatactgctgttaggaatatctgtgtacaggtttttacatgaacatgttttcagtttctttgagtagaattgctgggtcataaggtaacttttgaggaattgccaaactgttttccatggtggttgccccattttacattcccatcagcaatgagtgcgtgttccaatttctctatatccttgccaacacttatttctcatctttaaaattataactgtgaaaggaagacaaatcttgggaccctaaaatcactaagctaaagggaaaggtcaatctgggagctgcttaggacaaacctgcctcccattctatttctaaaaagatagctactaagataaaaaagttaacatacctccctctcaatttgtacacaagaaaattccttgtggacaaaggacagaactcaaagtcacccctctctttgttgagataaatgcatatctgattgcttcctttggaaaggctaatcagaaactcaaaagaatgaaactgtttgtctcttatttatctgtgacctggaagccccctccctgcttctagttgtcccacctttccagaccaaaccaatgtacatcttacattgttgatagatgtctcatgtctccctaaaatgtataaaacgaagctgtgccccgaccaccttgggcacatgtcgtcaggacctcctgaggctgtgtcaagggtggtcatccttaatgttggcaaaataaacttcctaacttgactgagacttgtctcagatactctggtttacataaccatcctagtaggtatggagtggtatctcattgtagtttttatttgcatttccctaatgatttatgatgttgaacatcttttcatgtgtttctcagccatttgtatatcttcttttccaaaatatctattcaattttttttattatttttattttcattttattttatataatattttgagttggagtctcactctgtccaccaggctggagtgcagtggcatgatctcagctcactgcaacctctgcctcctgggttcaagtgattctcctgcctcagcctcctgaatagctaggattagaggcgcccgccatgcccggctaatttttgtatttttttagtagagactgtatttcactgtgttggccaggctggtctcgaactcctgacctcaggtcatctgcccgcttcagcctcctaacgtgctgggattacaggcatgagccaccacgcctggtcggttctgtgtggcatttttatactatcctgcccagctgttaaaaggaatgaagcaaatctatacataataatccctgactagatctctaagacttaatgttgaacaaaatagcaagtagtaggatgatacattatactaccataaattttatataaataaatacactcaggtgtgccatgcatacacttacacacacacacacaaacactcacaccctggtactgttgagttaaatatatgtaagaggatagagaagggcctgatataatatttcccaaactttccaagatagttggttaccttgggctaggaagagagagaacgaagatgggggtggaagtggggtatgatctaaaggggcttttgtcttatttatgacattttacatagtatccgcatactatttggccaataaaacatgtaaaagctccttaaaatgtaattacaacctgaaaaaataagaacatgggagctgttggggaactgtagcaggagatgggttcaaatccatgctccatgccctctggcaagggaatgtgtattcattgactccttttatagctcagctttattttgtcttgggtccttcctctttttcaaaatagttttattattttttaatactatataacaattcaaatagcatggaggtttataaagtgaaaatgaacttatctcccctcttcacctgaaactacccaccctgaggtagttttagtgcacgtccttttcctgctcagcttctgtgttctggtattgtctcctgcccacccagtaagctgtgcttccatcttctcgttgatggcgaaagctccttcctccatgggaaagtgaagtcttcgttttgaagcatccatggaatggcctgcaggcttgctttgtgtcacctcctacccgagattgtgattgtgtcacctcctaccgagactgtgaactcctaccctacaatgagtaggtctggagttctacttgggcgtctttattttataaaaagttcccatggtgattctggtgaaccaacagagggttaagagtcgtttatctagggagtaacagagcaatcataaattgtgcccatgctgcttctttgagaattatttttggtggccactttataagagtgatgagcctgtcagctttatggaaacatgcctgaacttagatggtctgttttcttccaggaatttcacagaacttttactttaggttattttcagcatttgtgtttttctagctaaatattcaacatggaactgctatttgagtctgagaaagtgatcatggattcttttttgaaaatgatggaaataaacagtacacggcaaacttagcttgtaaactctgcatttcacattgaaaatgggtggatatggtaaaaatgataggcggtaaatcttcaccaggcagagtgtccttgggtcttgctttaaaatacttttcctcccccacagcctgacttttgtatttcattttagtgtgtttgcctgagatgtgagtgagaaattcatgtgatagatgtctcacgtctccctaaaatgtacaaaacgaagctgtgccccaaccaccttgggcacatgtcgtcaggacctcctgaggctgtgtcatgtcttaaatttgagtaatctttctcatatcttaaatttatgttaaagtttacattttctcttgtaggtattctcatgggagcagttataaaaattatagagtttaaaaaactggcgaattggaaggtaggtttgccctttggttgttcttaattttagtaacattgatcattatgctggcttttttgtaattacttggctatcagtggagttatttatattattatgttatatatcccattactttttaatttttttattagatacaggttgatgcctttacatctgagtttttgcaaaagcataagtctcatgctgtttcaagtgaacatgggcgccaatgtcatttttttttgttattatacttgcatttttgtaatcctagactaacctacttttttaggcaggaaaattctctaattagcattaaacattaaatactgtttattgctcccaattccattttgacaactgaggataataaaacatacttgtccagtactgtgagacacagtactttatatattgtagctcatgttattctcatgacagtcatgtgaggtggattgtctgggtattgtaatatcatcacctcgtttttacagatgaaaaaagtgacactcagggagattgggatgtattcagtgtcacagagctagaaagaaagtggccgagtggagtcttgtgtccaaaccctctggcctgaatatgcagtgttttctccaccataccaccccgtcctcagtttgctgatatatatacccttgtgttaaagaggttattagaatatgaacatcatcctggggtgcaagtactcattgaaactggaatttcaacataaacttgagcatccatgttgagtagggcgagattaacaagtatgctacaaaattgattttgtggagggaaataagattcatttcaaaatataaagaattatatggctaaaattgatcacatttaagcccttcctactttgatgaagctcctaggtgctaggattaattgacctgtgaaactgtagagtgtaaaattagcaagacaaaccttatagactaacgtaaaacacaatttgaagctgttataaatagtagtaatgaaatattttatatattaaataaattttgaaaatgtatattgagctctggagagtgataagacacacttctgctggggaggccccactggagcgcattgcatgtgggatctctgccttcctgctacttggttacatttaaccacccaagagtgggtcatgactgaagagcctttttctactcctaggctggatatagcctgatgtgtagattttgcccactaacccattttgtttgatctgatttaaaaatcatttgatcaaggctgggcgttggcggctcatgcctgtaatcccagcattttgagaggccaaggtgggtggatcacctgagctcaggagctcgagaccagcctgggcaacatggtgaaactccgtctctaaaaaaatacaaaaaaaaaaaaagatcaaaatttgaattgactttaaaacaattaaaaattgttagattttgggcgggtgcggtggctcatgcctgtaatcccagaattttgagaggctgagtcacgtggatcatctgaggtcaggagtttgagaccagcctggccaacatggtgaaacctcatctcttctaaaaatacgaaaaagtagctggacgtggtggcacgcacctgtagtcccagctacttgggaggctgaggcaggaggatcgcttgagcccaggaggatcgcttgaggctgcagtgagttataattgcaccactgcagtccagcctgggcaacagagcaagaccctgtctctaaaaaaaaaaaaaaaaaagttggggcaggcttcctggaggagactgcatttgtggagagtcagagtgagaagtaggattcctgcctggaaaccagatgtgcagggagcagtgggaagtcagaaaaacaagaggagctggtggtttctttccctgaagttctgattccaaactgacctgctgggtctgcccaggtagcaacctgtattatcatgtgcttaatatttttctatcaacttgctttttaattatatgtatatatatataaattatttatttatttcttattttctttttttgagacagagtctctcttggttgtccgggctagagtgcagtggcacgatctcggctcactgcaacctctgcctcccgggttcaagtgattctcctgtctcagcctcctgagtagctgggcaggagaacaggcatgtgccaccatgcccagctaatttttgtatttttagtagagacagggtctcaccatgttagccaggctggtctcgaactcctgacctcaagtaatccacccaccttgtcctcccaaagtgctgggagtacaggtgtgagccactgcgcctgggtgtggctaatttttaaaaaaattttttgtagagacacgatgtcactatgctacccaggctgttctcgagctcctgggctcaagtgatcctcccaccttggccttccaaagtgttaggattacaggattgagccacgtggcctatatatttattttattttattttatttttttttttttgctggggagtggtggggagcagagtctcactatgttatccaggctggagtgcaatggcgtggtctcagctcactgcaacctccgcctcccaggttcaagcagttctcctgcctcaacctcctgagtagctagaattacaggtgcctgccaccacgcccggctaatttttgtatttttagtagagatggggtttcaccaaattggccaggctggtctcgagctcctgacctcatgatccatccaccttggcctcccaaagtgctgggattacaggcatgagccaccacgcctggccatgtttattttcaaggcaacattacagtactatttcaattcagaaactaatattgttttgtaaacatgataaaaatgaagtagtacagatgcctgctgaagcatcagaggtcaagtctgctctctgtcaagggagatcagcacgttggagagagcccttagaagcggtattgccatcctaaggtgtcttggatttatttgggcctgaagaaataatcaaaaggggctgactctctcaatccatgaggtcagtggtatttgacacacactgctcaagtgccacctaaaatcacctcagaacattttgggggagccattgccaaaaggaactgtaacactatttccctgaaaggcagtgtgttcataagggctgcagtaacaaattatcacaaactaagtggcctaaaacaacagagatttgttttctcacaattctggaggccagaagtgagaagtcaaggtatcaacaggaccaggttccctcccaaagactctagaaaagaattcttcattgcatcttccagcttctggtggccccggttttccttggcttgtggccgcatcactcctgtctttgtctctgtgctcacatggcattcttctccacgtgtctatgtgccttgttctgtctcttacaagtcgatgtttgctgcctttggccttcccttatccagtgtaaggtcatctagatccttaccttcattagatcttcagagaccctatttccaaataaggtcacactctgaggttcctggtggccatgaattgtgattggggttgggggacactatataaccccactataggtagattctcctttttcctggggtggggggggctagtttttatacctccaaaaggctgtatatagtggtcctgctgcacagatcctgagaataggttgccccgtaaaacacagagctcggctcattttttttcacacagtcccagtctgaatcatgagcttgagcttgttgtacatgctgctattttaagacttaataaggcatttcagaagtcatcatttgcttctattttgagcgttttttgactttcttttagtctttatggtaacagctgtacatttgtaagaatacatttaggcattctttggaataggcattttgacaaaaaatcagactgtcaaaattgtgacatgggaaaatattcatatgaaaaagggcctgattttgcatttttaaatagactgtgtattacacataaccattttgggcttgaggaccaatatatatttccccaaaattctaccaacaactagagagatatattaataatatagaaaatgaaattgttattgtttcacccctccaaagatggctatattctagaaacacctttcgtagtggcacttaataatcaaatctggaagcatggtgctatggtttgggcatttgtctccccaaacctcatgctgaaatttgattccagtgttggaagtgtttgggtcatgggggtggaccctcatggatagactgatgcccttgctgggggagggaggtgaatgagttgttgctctgttcgttccctatacagctggttgttaaaaacagcctggtcccatccccgccccccctttcttcctctcttgccatggatctctgcacactctggctccccttctcttcccccatgagtggaagcagcctaaggttcttatcagatacccagtcttgaacttttccggacagcagaatcatgagccaaataaatgtttttcctttgtaaattacccagcctcaggtattcttttatagcaagacacatggtaaggggctgtctttgtatcaaagtctcaagtcgaaagagcatccagtgtggactgttttatcacatcagactttggaaaatggcagagttgtctgtgataagcagaaagaaggcagagctattttaaccatatataggatttactgttcctctgagtggattgttttagggcttgccattacctttttcctggaggattccaatttgtggagttgtttttgaaagtctgcaaccagaattgaaattttctgtattcagattaattttctttctgtactaaggaataaaaaacatactactgtgttgtgctgtttcttttcactgatcacctttaaaatccttgtcttggccacgcatggtggctcatgcctgtaatcccagcatttggggaagctgaggtgggaggattgcttgaggctaggagtttgagaccagcctgggcaacatagcgggaccctgtatcttaaaaaaaaaaaaaaaaaaaaaaaaaaaaaaattagcccggcatggtagcacgcacatgtagtcccagctactcaggaggctgaagtgagaggatcacttgagcccaggaggttgaggctacagggagctgtgattgcaccactgcacttcagcctggacaacagagcaagaaagactctgtctcaaaataataataataataataatgataaaaataataaaatacagtttcatttttttttttggtgggggaatctctcattctgcttgattttattatcaggtagttatttaaacattatatgtttccactaggccaggccctgagagaataattattttggctctttattgattaatttatttcttaattacacaaattccatgcccttaagatactcattttctatttacaggaagaagaaatgtttcgtccaaacatgtttttcctcctcctgcttccccctattatctttgagtctggatattcattacacaaggtgagactcaggcacacattggtgctttggtctggacagtttctcatgtttgtaaggcaagttccttaaaagcttgggtataatttagcagcagcagcagcagcagctctgctccttcctggttgtgctcagtggaagctggactgcagtgcctgacttctggagaggagcagacatgatgaattggctgctttaatggtttcaggcagtatggctcactgagccagtgtttgccataaatgggtgctttgcccaggaagatggctgaagtgatgttaagtggctcacagatgatgcattgactcgtcttcctggacacagactgatagatgtaaagaggatagactgtgtcctgggacgacggggacatgtgccccaggacttttgtttctttcagctcccccactggggcctttctaaccttctcaggcccatccatccttccatgtctccctctcggtgccctcccctggcctcagaccccagcttgatattccccttcatccctcaacctctatcgctcctcgcccactccctggtccagcttctccttcccaggctggagccccatccttccctgcctagtcccacagttgcctgcccattctttcctccctgccttggtgagcagtggcactggcccctacccacttctctgctttggcttggccttgacggccattgccttgcaactcccagtgtgagatgtttttttttttgttttgttttttttgagatggagtctcactctgtcacccaggctggagtcctgtggcatgatctcggctcactgcaacctccaccttgtgggttcaagtgattcttctgcctcagcctcctgagtagctgggattacaggcacacgccaccttgcccggctaatttttgtcgttttagtagagacggacggggttttaccatgttggccaggctggtctcgaactcctgacctcaagtgatccacccaccttggcttcccaaagtgctggggttacaggcatgagccaccacactcgtcccctagtgtgagtctttctgcctgagcaggagcttctcacttttaagcctgcttgtgtgcgtgcatggttttttccttgtctgtgagttttctttaaacataaatgtatttaagttttaaaataaagtgattcaacttaaaatactagtattaataatacagcagctattttgtgaatgtgatttttaaaaaaactgtgaagattggaaagtttaggccagtccttggagagaggaaagccagagacacaacacagatctaatcatgcgctgccccctacaggtttctttttggtaaagtagaaaccaaaaaccccaaaaccctacctcccagggtgctttgagagtcacactagatgaaagaacgtaggcaaagcaccacccaccacactaaataaatgaagtgctgctgcttgttattaatgataaaaatgtcatttattattaataacaatattaccaccagtagtaataataatttattaagcttaatatggtcgggcccagtggctcatgcctataatcccagcactttgagaggccgaggtgggtggatcacttgaggccaggagttcaagaccagtctggccaacatggtgaaaccccatctctactaaacatacaaaaattagctggtcgtggtggtgcgtgcctgtaatcccagctactctggaggctgaagcatgagaatcatgagaatagcttgaactcgggaggtggagcttgcagtgagctgagatcacgccactgcactccagcctgagtgatagagggagactttgtctcaaaaataaataaataaaaataaacttaatttgttgttgacatggtataaaataaataaatacataattttaaaaaatgagttagatttgtctagaaatgtttggtaaaaacatagaaattaagtctttaattttcctgtactaaaacaaaagcatattaagatgttcagcccagatttttttttaagttattattttattgtgcatctatccaaagaaaaagtgaaaaggaaatttaatgtaaaaaatattcacaagtcttacaaactgttagtgacatcagataatttttaacaaggaaacataagttgaaggtcaccatgtctttcctttcactttgtaaacaaatcttaactgtaagcagatatgaaaatatttcaaaacatgctgaggaaattgacttgattttgacttaaaaacatgacattttgaatattagagcatgtaaagtttttcttttcttttttttttttttttttagaggggagagaaacttgttcaaaatttgaggaaagtaatagttttttagagaaacattttgttgaagatgactttccagcaggaaatgtgacaatttatatgaaagggactgataggattatgaaatgctacttctgaaacttctatccactttctaccctcgcccaaagatgataggaagtaaagtttgaatattttattttaatattatgatatctgctaatgtaaatttggatttagaatacagattacagtaagattatcatcagttgatatgcattagctaggcagcaactggttctttgaattgcaaatattacacaaatcacaggatgttaattatgtcagagagaaacagataaatttgctttatgtagcagagggaagttcttgtattatggtaactttaacttgggtaaatgttcaggatccagattaatattaaccaaatatataaattatatcaacattagatctctgcaaacaggtcaaaactgattaatctgtttttttttttttttttttgagatggagttttgctcttgttgcccaggctggagtgcaatggcacgaactcggctcactgcgaactcggctcactgcaacctcggccccctgggttcaagcgattctcctgcctcagcctcccgagtagctgggattacaggcgtctataaccacaccagctaattttgtatttttagcagagatggggtttctccatgttggtcaggttggtctcgaactcctgaccttagatgatccacccgccttggcctcccaaagtgctgggattacaggtttgagccaccgagcccagtctaatctgtttttaaataacaaaagaaaacagcgatttgcaaagagcaactcatagattgaaagccctttgttttgaaaaaccaaatcattgtgttttaaaattctttgtgcagtaaagattgatatgccaaacaaaggaattgaatgtcagatgataggcagccaagtcaaaattgcagcttctaggaggtgggcttagtggggcagtcagtgttcagctgaggacactctttcacaagtgggctttaaaatagcaggtcttgatgtccatggtttggtgatttctgagctaaaaacaagattcttgttcacaaccacaatcgggggtgatcaaagactcttggtagctcctaagtggagttcatagggttataataaatagcttaatttccttaattttatggaaatttgaaagatgctaccatgctgcttgaacttgaatattttatcttaaacgctgtgaagtatagatagaaacattttatctgacatagttaatgatgatactaatagagtgaagtaaaattgtttaaaagacctggccaggaaaaaggaatatctgatagtgtatcttggtatcctaatagtgtggactttggatgtgaaacacagttaattccttcagtgcctgtctgttgggcatcttccatctgacgggcattatgtcagggaccgtgttgtgcgaaagcaggtggggtcattgcccagaatgagcctgcagcctcatgggaaagtaagacatcagtacataaataagtgcaaaattgcagtcttgtcaaccgctacaagagagggtgactgtgcactgagagcacagactaggatctgggaagagttgaaatgtcctgagatcttgggatgatgaaagcttaacaagcaaagagggagcacaacctgctcgaagccaccagtgggactggaacccagagaacaaaggcgagcatggtgccagatgagcccagaggcctccccaggagtcgaatcattcagggtgggggctagctgcattttaagtggaaataggggtccaggtgaaggcagcacaatcagatttgtcttttgggaagatcattctggaaagacgggagagtggagggaaaggggccctggggggttgaggagacttgtgcgaagctatgcagtgtttcagatgaaagatggtgtgagtgacgggacactgcagtaagtgcgggggtgcaggaagactcccgggctcccagcttgccacacaggttgggcagtggtgccttttacagagaatcaagtctgcacggagggccaggtgtgcaggccgtgccttcactgacaggaatggcttttctaatcatttccctgatttctgctctttcaaacagggtaacttctttcaaaatattggttccatcaccctgtttgctgtttttgggacggcaatctccgcttttgtagtaggtggaggaatttattttctgggtcaggtaagaaaatcatctttgaaacactttgaaagtcttacattcttagagctagtgcagggaggtgggaaggtgaaatggggccactttgtggggcctgggtttcacccttaaggtaaattccttctggaaggaaatcctagcttcatatgaggcacagtagaggcgtgctaaattgtttcaaagtgtcctccaagacctttggtatctggaattgagtaaaacttttccataatcccccccaaagtatttgagtttatttgcaaaccaatactgtcttaaattagaatacctaaaaatgaagccaaatatatgccatcaagaacttcaaactgtgttgtcaagtagactgaattggggttgaatgctgttttttgataaaaatttgtatttaaaaaatcaaagatgtgcttttctgctggcattggagaaataataaaatcaaaggtgatgctgaatctcttcactcaattctaagctgtctacctgtagaattatatactctggattttccacaattgctaaaccacttcccagtggcaccagttgggtggtctctactttagacttcaaattaatttagaccaaacatccctaggaaggtagtatctgtagttttgtattatgcatgtccatgcatgtcacattcttttcctttattgtcagttgcagaaagtttgcctgtctcagttctgaaaattaagttgagggtcaggtatctgagtgacgggcagatttctttaacacatcagctgctttcttctctcaatagccaaagcccattccattggattttcacctatattgcagctttgatggcaccagaataaatctgtctgtcatgcagctttcttcattgctcagcttctagtattaagtaagaataaacttaaggaaactacagttaattgggcttgaagaatgtagcattcttttccatactctcgttgcatgccgatggaatgcatgtttcaactaaggcttaggagcttttatttttcaagtggtttgggaactgaagattaatgtccttattagttttaataaagcactaatggacatttaaatcttggctgttctccagggttttttttttgtgtgtgtctgtgtgtttgtgtgttttattttacaggctgatgtaatctctaaactcaacatgacagacaggtaaatccttcatactgtaacacccatgcgactgcttttcagacaggggaaatgtttctccacattgcttcctgggtgtggtactgttctattctctctctgtgtatttatttttggtaaggatttctgccatagaatcttactctgagttaatttgtatctctgaaatgaatcaaaagtatcctaaagacttttgaagatccctagtggggcattgctgattggaatgatttagtttaagcttgggagggagtaactctgctcagctaactgccctgcctgtgtgcacgcgtacactgtaccattgtcttcttatttacaagacttttcagtcgccgtaacaaaaagtcttcttgacagattagagatggagagggggagtgacggagaaactttcctctgggattcccacgaagcctgtggtgggggaagcagggccaagacctctattgtggttattgtagaaagcccctccatctgaagccactcccgtgagcacttcccatgagccccatccaggatttcccagaattgcatagtgagaagcaacctcactaggttgaggcagttgtctctcagaaggtaccagatctagtgctgaaaaagtgcccatgctgagcatagtctgggttcccccctctgagagcagacagccttgctcagtgtgtctgcatttggtcttgtgacatggctggggagctgggcagcagggtcacatgttcgtccccagatccttgccatggggccagtcagagctttcaggatttagcagcagtttagcaacttgggactagaatctgggaacccttttcatgggaactgtgtctctgataacaaatccaattctatttctacctccactcaccacccaccccagcccaggacaattttggagcttttgttgtaagacagttttgatacataaacaagtagtcctattccatgagagctggaaataaagcagaactgatgtcctgtgtttggtaggtattttgcaaataaaaagaaatgcccagtaaaggaaggtatcacagtattcaaaccttccacttgttttgggggcaactggttagagatacagacaatgctggataacttcctgtgaagttgaattgaatcagtggttgggatgttcaggtggaggacaggaaaggaattgccctgtagacacactgacttagagccgggtagtgttttcctctccgtgtgcagaagtttcctttgctgttagaaagtgacgatccctcagatggggactgctctggggtcgcaaacccacacagccgcagggcctggcagagcacttaacagagggaagctggccagctgtgagtctagacatggggcagcggccagtgggagaacacaccctgtatgaagggacagccacttctcagcgccaactcatgattaccatgtggaaatctgggcccagaattggtggctattttaaatacttttttttcaaaaagatgctgggtttctagatttttatagggaattttccagtttttcaatgttgacaacttgctcaatttttcacaaataccatgcagaccaaacatgagaggggaccacagactttttgcaacctctgcactgtagaaaacataaaaataacttcgttgcacacgttttgttttgttctagtgatatcttgttggagagagatttcactcttagagatcctgaattatttcgctgccttagttcatttctttttcattttgttaatgttgctatcttttggggctatgggataaagaaaatacatttttaagttgaacttctggcgtttaaaaggcgaggtcttaaagatgtgaagtggaacagctgacagccaggtgaaataaccgtctttccatacagacctctcaatgattcagcagtttgtatttcagacttctcatcttcactgtcagaaatactctgcctcaatttagattcccaagcaaactgtgtaacatgatttatacaaagcatttcccccagccttttgtttgttttgtttttttcagttaatttagaaagtttattttgccaaggttgagcatgcgcacccgtgacagcctcaggaggtcctgacgacatgtacccaagatgatcagagcacagtttggttttatacattttagggacacatgagacatcagtcaacttatgtaagatggacgttgccccaaccttttattatgaaaaattttaaacatacagaaaaggtgaagcattgtgaagtgaatacccataaacaaatttttaaaatataaaaggtgtatcctgcaggggtaggagaggcacaggacagggaacttgggagcctgtggtgggcctgcgcttcactgaggctggagtatagtggcatgatcacagctcgctgtagcctcaaactcctgagctcaagctgtcctcctgcctcagcctcctgagtagctcggactacaggtatgcggcaccacttccggctaatttttgtgtgtgtagagatagggttctctctatattgcccaggctggtcctgaactcctgagctcaagccatcctcccacctcagcctcctaaagtgttgggattacaggcgtgagccactgtgcccggcccaggatacactttttagacatcatcctccttccttcacggcctctggtgatggggctgtggttgatgagagtgaaaataaaagagcgaccagaagctctgtctgggttgtggtgcaagggcctggggaccagccaccaataaaataggatctcccagatgggcagttgtttagtggagttaccttccctttcttccttccctttcttcttcccacctgcctgcctgcttgccttctgcaagtgtctctgggccatgcccagtacagaccctgggaattcacccatgacgaaaattcagcatccactcccttggagctcacaggcctgtgatgacctctgtgaggacaggcgaagtctgggaactgaatcctcagcctgggatccggaggcactctgggttaatgcgcatgagtcacattcacaggcagctaccatggaaaccagaggccagatgattgacttctgaagagaactgtacctggcaaggcagccaggcatttcctcagtcagctctcctctccctgaccctgcagccaaaagatcacccattgaaggctgctcagccgagcatccttttccccctagacccaggcttggtgagggtgggaagctcagggcagtcgtctctggctgatgactgacacaggctggccattgggtctccatgttttggctggtgttgtggaagggggcagacccaccattctgctgccctggaaagaaagttgcaacaggcatggcacagaggcttgtgggaaaatcaccaaagggcagggagagtgaattgtccaggctcatgtggcacatgaggccccttgagggagctggtcctgcctccctcgccagcctcttatggctcctgccactcaccccacccccaccaccacatgcaccttccttctgttcctcaggcagcaggcttgctcccaccgcaggagtcgcttgctgtcacctcagcctgcagctcttggcctggccagctgcttcttaacatgtaggttcttgcttacatgtgtcatcccttcacagaggcctctccagaccgccccatctaagtggctcccacacccacacccccaccccaccttcccacgtcacctcaattgatttcctgggtcacatgtggtattgtctgaatttgccttcatctctgggtattgctgtatctactgttgggggtaggagtaccgactctgggcagatagcctggctctgctacttgttagctgagtgaccttggacaagttacttcatcatcccgttgtccctcggttttctcctctgtcattggggcagtagtagcagtctcatacagtcactgtctggattgttgagtcaccgtatgtgaagtgcttagaacagtgccggccatggtagcctccattcctgaaacatgttagacaatcagcacatatctgctgggggtgataagatcttcacggggactgtcagtgaggtcactggcccagttgggagatggcctcagtgtttctctcggctgtctacgccactcacccccaaagcacactggggttgctgctgctttttgacactttcttagatcttgcaaatctgagtgcaggctggggtcggtcacggacagcattccaaggggctggtggcgaggggcagagcagaggtcagatgcaggagctcatgggccatttggctctagctgctctgacccgtggaactgggcggtgtatgataaatatatctaagcaaaagtctcccttccatcattggtcaaagtcaagtctccgtgctgacactagaaaaccaggccattcctaacaactcagtttagagtgggcctttcatactccacccacaaaacagcagataagtggggaaaaaatacgctaccttctgtaattaattcagctctagcgtgtagtattgctttctgttaaatatggcctttgactttaatgctttaatatgtggaccaagtgacacacattacagaatctccccttccctctgtctcttacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaagtaagtacgggggcagagaacagacttttttcatgtgacagaactaaaggtccttgtaacaaaggggcagatatttccacacagcatgtgtacagttgcttgtcctctgggtgatcagttcacccactctctttctctgtatttctgtcctgacaagccttgatgtgctgcaagaatatggtcaggttccaggggtggttaaaagaggagagtccacctttttttttgagacagggtctcgctctgtcacccaagctggagtgcagtggctccatcacagctcactgcagcttcaacctcctgggttcaactgatctcccacctcagcctcccgagtagctgggacttacaggcacgtgccatcacgcccagctaattttttaagaagtttttgtagagatggggttcgccatgttgcccaggcttgtcttgaacccctgggctcaagcagtttgcccacctcagcctcccaaagtgctgggattacaggtgtaagccattgctcctggctttgcccacctttttcgacctgccttttagtagtggtttctgagcccagcttgtcaacatcactgagggtgcttattaagtgtgacattcctaggccccaccctcagagcttctgattcatttggtctggggtgagtcccaagaccatgggtttttaataagttccccagatatgatgaagcggcctgttcaggggtcagtgtttgggcaatattattggcaacaaaagcaatagacagaggccccactagctgatgcatgtcaccttccttttcacagctttaaaataaggtaggaatgctgataggtgccctgccttaagatgctattgtgtaaactctactttggacactacaatttgttttcaaatatttgttggtattactaccctaattgatgggatctgagaagttaaagatgaataataaaatgtcaagaagtcattgggggccaggcgcagtggctcagtcctgtaatcccagcactttggaaggccaaggcgggtggatcacctgaggtcaggagttcaagaccagcctggccaacatggtgaaaccctgtctctactgaaaatacaaaaattagctgggcttggtggcgggtgcctgtaatcccagctactccggaggctgaggcaggagaatcacttgaacctgggaggcggaggttgcagtgagccgagatcacaccactggattccagcctggtgacagagcgagactccgtctcaaaaaaaaaaaaaaaaaattttagctgggtgtcatatcacgtgcctgtattcctagctactagggatgcagtgagctgtgatggagccattgcactccaacctgggcaacagagcaagaccctgtctcaaaaacaaaacaaaacaaaatcactgggaaaagtaaatgcatttcagataatctcaaatatatttttctgatgcagggatatttccttgaactctgcattttatggtggtcattaacaggcaggcaacaaacccaaagatttttgccaaaacacagatgtttgagaccagtctggacaacatagcaagaccccattctcccaccttcccgcaaaaaactccaaagcacgtggagaaaagagccccggataatgtatcaaaaatgagctaagagaatcttagaggccagtgtgtgttctgttagataatagaatttccatttacctgaatactgacttactgcctttgctaaagcataaccactctgtggtagctggcattttcttagaagtttttttatagactatattcagaattcttatgttggaataaaatgcctcagcctaggactagatttgaggactgaatagttaaataaggtactacagggctgggcgcggtggctcacgcctgtaatcccatcactttgggaggctgaggcggatggatcacttgaggccaggagttcaagaccagcctggccaacatggtgaaaccccatatctactaaaaatacaaagattagccaggtgtggtggcgcacgcctgtaatcccagctactcgagaggctgaggcaggagaatcgcttgaacctgggagacagaggttgaagtgagccaaactcacatcactgcattccagcccgggcgtcagagtgagactctgttttaaaaaaaacaaacaaacaaaagggtactatgagaaaagcatccagcattgggtaatgtgacatcctttccttttctttccctgcccctagttgttgttttcaccacatttgcccagtttttgccctgtttttgcccttcctttgcaggaggagcttaccaaatactgcctgatggcaagaggtgctcaacaggccttaaaaaacaaccaaacttataagtatttttgttattctaaatgtagtacatatattcttaccaaatttaggaaatacacaagcaaaaaagagagaagtatcacacacattgctactacctagagataattatggttgataatttggtgtaaatatatatacattttatttcaataggcttataccccaaatattgtactctattttccattgaacacaattgataaaacagtcttctggaaaataattttactggttacggtgtattcctttttctgggtttactatgatctacttaaccagtttcctactattggctttttcatgtttctcttggcagaaatttctatagctttattaggatattatccaacatcatgccacaagacctttaaaaaatccaatggcagtattttttcttatttaagatctactctgaaagctgcctagcattctggtttttacttttatctcgtatcctggctacacatattgaacatttgtgacaaggaattttgcctaacttggaggtgacatcatgagttatttttatgcattgggagctaaactcaattgctttgtctcttgatttttttaaagaaaaataatttttcagaggtaggatcttttctgagcttttccagttgtctctattataaaagccaaagataggagactttttctatttaagatgggaaatgatggagtcatcgttggtagccagaggttcttactggaaaagtgctttggaaacccaagatggggccaggcatggtggctcatgcctgtaatcccagcactttggaaggccaaggcaggtggatcacctgaggtcaggagtttgagaccagccttgccaacgtggtgaaaccctgtatctactaaaaatacaaaaattagcccggcatggtggtaggtccctgtaatcccatctacttgggaggctgaggcaggaggattgcttgaacctgggaggcggaggttgtagtgagccgagatcgcaccactgcactccagccagagcgacagagcaagactgtctcaaaaaaaaaaaaaagaaagaaaagaaaccaagatcgtctgtggtaacagttcccacagttggatctgtggagcatgcatgtatagtttccagtctcctcgtccaccagcagcagtgctactgctgaggccacggttggatctgtggagcatgcatatatagtttccagcctcttcctctaccagcagcactgccactgctgagacccaagctggcttgagaatcagcctcacaaactctccagccacggctggtcatctgccatcagcatttggtgagggacctctgtgtgccagacactgctgagagccaggtggatttgacagtcggtccatgatgggcaaaagatgcccgtagagaagtgaacatggtgccttaagcatgagggggctcaatgaccagaccatgaaggatatgaggaaggcttctcagaaggaacgtcttgtgagccaggcctgggaggcttattttcagacagaagatacagaaaaggggcatgtcagacttacccccgcctccccctccacctttttttttttttttagtacagaagaaaaatatgctcctgggagctgttgtcacctttccttggttatcagaatcatacctggttttgaagaggtatacttcataaacgatcatctccaaagtgagctgacacatttatctttgcaactgaatatgtaaatgagttaccccctttttgatgttgttaccttcatgaatgccagaaagcaaatgtcttctgtttcttcggtaacttgaattcattttcagctttgatttgttgctatgatagtgtgttcttaaagtcactgctgtagaggaaaccttttgttttctccagctacagcttaagctcatgaaatggaccctgaagcaatactcccttttattctttaaggtatgagaaacatgaccttaagaaacaaaatgtagaaaattaccaggccagaaagagtccaaattctactttcattacctggagttcagaaaccattgccccagccctggatctgctgttaaccctttgtgtgaccttacccagtgactcactctctttgggcctcaggctactctgtataaaaagcagtgaaaccagcctgggtacctgctgtggtagtgatgtgggctgaggctgggcactgtatgtgtgtgacctgcagatccatttttgggaactatgggtgatcatggccttcaaaagcacttttccaatatgagcccttgttggctgccacattcctcaaggtgggatgttaacctgtgatctgctagaaagaagggggattggggagattgtttgttcagatgagtctgcaaagctttcacgtgaagaaagttagatttcttttttgcaagacttctcagacctttattatgttattttgggctgtgaatttcctcgaaaggctttctgagtttatttgaccaagctaccttttcatcttattctgctttaaaatgataccaatcctggggcctggcatggtggttcatgtctgtaatcccagcactttgggaggccaaggcaggtggatcacttgagggtaagagttccataccagcctggctaacatggtgaaaccccgtctctactaaaaatacaaaaaaaaattagctgggcacggtggtgcgcatctgtagtcccagctacttgggaggctgacgcaggagaattgcttgaaccctggagacagaggttgcagtgagctgagatcgcaccactgcactccagcctgagcaacagagcgagactccatctcaaaaataataataataataaaatgatatcgattcatgacatggtgattgatgaagctgaatattactgttgactattctttgtttcatttactgagtcaacaaaaaggtattgactgtcttttgtgtgggaggctctgctttaagccccggacataaggcagcgaacaagatggacacaggcttcatcctcatggaatgaggcacgacagtttcccatgctgtgaaggagaagtcaagcaccatgacaacctttaaatgggcaggcctgcgtgaagggatcagggcaggtgtgcctgagggagtggcactgaccctgggttctgagggatgaataagggagttagctggggcaaggaaaagtgaatggtgaccacctgggaggtgccagtgacagtgtggcccagatgtttagatttggggagaggaggtaaggtcagagaggtatggcaggcaggagccaagtcaaactaagactgggcttcctgataacgtcgggaaactgtgagttctgaacaggctggtaacctgatcaggtgtgcctttgaaaaggatcagttagggcctgtatttctagcactttgggatgttgaggcaggcgaatcacttgagcccaggagttcgagaccagcctgggcaatatggtgaaatcccatctctacagaaaatacaaaaactaactgggtgtggtgatgtatgcttgtggtctcagctactctggggctgaggtgggaggatcacatgagcctgggaagcagaggttgcagtgagctgagatcatgccactgcacttctgcctgggtgacagagtgagaccctgtctcaaaaacaaaaagagggggatcatctaggccactgagtggacaacggggttggtctgtaggaaggcaaggatgtctagaaggagatcagtgagacttatccctgggagtaaagggcagtaggggagggaagaagggaatggatttgagagacacgaggaggatatttaatgagaataactcgatgttcatggtgtaatggttttatctttaaggacaaaaccaacaattgaatttaataacatctgacattttactttgttctgttacagtaaaaggaaagttctttctttcatttcttcctccttaatgtctcctaaatcctccctctcagcctgaaacctcggacatttcttctttgggtagctccattctaatctgacttgccatagcctcaatttcaggttttatcacaggatttctgtactgaaatccttcctatcgactccccaggccttcaagctgaaataccagcacctttcctgggctctttcctgtccctctgccactcttctcaccttgcctcctgccactgtcccacccccaccccaccgctgcgttttagctgcactaatcttggtacttgaaagttcctacaatgggttgcatatgcatgggctctcttcctttgcacatgctgttccctcactgggtgccttcccccatttcttcacctgggcaagtcgtctttatcccaaatctaaacccagcccccggccttttttattttttatttttttgagacagagtcttgctctgttgcccaggctggagtgtagttgtgcgatcttggcccactgcaacctctgcctcctgggttcaagcgattctcctgcctcagcctcccgagtagctgggattacaggcgtgcaccaccacacccagatagttttcgtatttttagtagagacggggtttcaccatgttggccaggctggtctgaactcctgccctcaagtgatctgctcacctcggcctcccaaagtgctgggattacaggtgtgagccaccacgcccggcatcagcccacattttctcaagcaccttccttgagcccggccagtctgagttagttacctacccaccctgcttttctacagccctctacccctcccgcggattgtcattagtgttcatcttgtttttctccctcattagcctgaggggaggagctccttaagggcagcagctttgctctcatctctgaaccccagaaaataacagtacctgggacaaagtaggtgaacaataaacgtttggctgactgaatgaatgatggtatgaatgaatgaatgaatgagcgaataagcaagaaatgttttaagttaatttctaagaactttgtgtatataacattttaatttatttctgttttctttcatttcctagcacagctgaaggtttaacaagaaaaaatatgtcagatgtcagtgggtggcaaacatttttacaagcccttgactacttcctcaaaatgttctttggctctgcagcgctcggcactctcactggcttaatttctgcattaatatccttttaatgtgatgaacatgcagggttaaaattattcctgataacttctgtctctagccagtttctcctgttttttaagggggccaattttagatgaagattttgcttaaaggaggatttttttgcttagtttttgtttgagaaacactctaactcaaggattttttaatctaacgtgaaatttaggatgtcacttttcaaagtttaaaaaacatgtacactgttggatatcagatgtgattttggggacctctcagttcccagagtatgataaccacactccgatgattttcgttttctgccatcttacttttcacatttggaaaactggaaattaattttctttgaaaatgtcaaatagaccaggtgcagtggctcatgcctgtaatcccagcactttgagaggctaaggccagaggattgctttcgcccaggagttcaagaccagccttagcaatggaatatagtgagacctcatctctaaaaaatacataaataaaaataaaatgccaaatagagaaaatttttatcccactgaaagtgtttatccagaaggattgcaaaaggggctttcaaagtgtgttccattgagttatttgcactgattttgttgtttgacaaccaataagcttttccagctggagatggaaagaggcttgttaaggccaatgtcacctttattgctgtagaaatttcattatgtttaaaatagtaacaggcagtagaccacttcggtgcgcacctaagcctacgtctcagggagatggccacctggcccgcctccacgagcagtttgtgtcacagatggccggaagagactcttttgcctggttacaggcatgtttttctgccatcctgttgaattttcccatcaactcctttgtccagaagtctaagggctctattgagttggctgacagcttctcatattgtaccaataaacagaatggaaaagaaaattttttccagttcagtattttcctctatatttatctttttctttaaaaaaaaaaagtatctatcaaaatgaagtggagcaaatgggtactgtgagctccagtataggcattgtgaatgatgtttcaatatatagaaggctctctcctttcacaggggcatgagtttggaaatctccaggaataggaaatactgtgcttcaacagggcctcgaacctcagtttgaacagcgattctcactagttgtctttgactcaaaactgatggggaaagcaagatgggtagcattagtgatctcatccgatgttgttggaggagtgggggtgatgccggccctgggaggaacctggccaagtgagctgtccttggtgtgtctgcagccccagctttgcgccatggcccggcacatccccagccctctaagtcagcgtttttaaatgagttgacttaggttgattttcatcttccaccaccatttatctccggaatttacatttcttagtgttttgtcagattccctttcttatagcaacagtctccctacaaaggaaaaaatccataatgacaaatttccatttgtaaccttgggacattctaaaatctatatctgttgtttacttcatatatttggaaagcagcagttttgtgacttctccacatctcccatcaactctccctcgattctccttccttgacagttgtcatttacgtgctgaagcatattgacttgaggaaaacgccttccttggagtttggcatgatgatcatttttgcttatctgccttatgggcttgcagaaggaatctcactctcaggtaagtgacagagagcctgaaagtgctgtggtgatggcatcttgtcctgcctggggaaagaggctttgtcagttgggtcacttttagtcacaagagacagtcacaactcagaagagcttaagtaataaaggaaatctattggttccctagaaacacatctggatttaggcctgcctggatccaggggctcaaacagtcacattggtgtcacggtcacattttctcttaacccgccttctctcatttagcccatcagtcctgtgaggctccctcagaggagggtagccttgtaggagggaggtactgtgaaggtccctgttttactgatgagaaaactgaggttgagtgagattaagtaaattactcaaggtcacagctgggattggtggaacaacgattcaaactagttgtcttggagtcaagaactagtgcttagaaccctctaatacaactccctccaaaacagatcatcatgaaaccatgtactcagtgctacatagagggacaagcaaagtgtggtggtggcgtaatgttgggcgtttattggacacactttaccagtattcagtttttttatgctgataccagccctgtgaagtaggtactaagaggttgtcattagcccaaagctgcactgcacaagcagtggtggtagtgagattgacagtggaggcccagagccttttccctgcaccccattggaggagggcacacagctctcagcagcagagacgactctgatgcggccctagaagatgatgctcaccagctggaggaggggtggccagtcacagcgtaatgatcttggagccgtcacctggtaatcactcagcagcccaatcaggcttggcttagttgggctttctgcctacaagtggcagtcaagcttgcgtccacagcttgttacgttgtaaggatgttgacctgaaaatggagcgtgactcacccctgttcctgtgtgagggggcagccagttgggaagggctctgccctggaagtctgatcccatcctttgagtgaaggcccttcagaggccttgttctggaaaggaggcactattgcagggatgttttgatctgtgccacaagatggcagagattttcttttttattaacttcgttgaggtataatttacacacaatacatggacccgttctaagtatatagttccatgaatttttgcaaatgtggacagtcataactacccccacagtcgaggtgtggcatattcttatcgcccagtgtggctcccctgtgcccttctgcagtcagtccacctgcctgtcctgagccctggcacccactgatcctgcactgtcattgtagtttaaatgaaatcatgtggtacgtagtcttttgtgtctcctctctttcagttacgtttttgagagacatccgtgtttttgcgtgtggcagtagtttatcgttcttattgcaccacagtttgtctgttcatcatttgaagggcatttggggttttccagatttgggctaagaacagtgtgcatgtgttttcatttatcttgggtaaatacctaggattaaggctgctaggtcatatggtaagtacatttttacttttttagaaactgcctagtgtttttcgaagtgactgtatcattttacattcctcagaatgtatgagagagtgccagttgcttcatattgccaccacacttattttaatttaaaaaagtttagctgtcctgataggtgtgtagcaactgcatttagatgtgctttggtgtggttatttttatattcgccttgggttcattgagttttttgggtttatagtttatatgagtttatagctttcatcaaatttggtaagcttttgcccatttctttatcaatatttttttgttccgccttcctcttccccttgagacttcagtttactccagttatgagaggtagcatgctattggcccacaatatgctttgcctttttttctttttttccctatgtgcttaattttggttatttcctgttgccgtatcttcaaagtcactgatcttctgccatgtggaatctcctgctaatcctacccagcgtatttctcatttacatattttataattcatctacagcagatccctttaggttattttcatttcttccatttctctcttcatcatgttcatgttttcttctatattctggagcatatgaaacatagaaatttctgatagctgttttaatgtccttgtttgctaattccgtcatctctgtcaactgtaggtctgttttgttgttgatttttcttgtgcttataggtcacattttcttgctctttgcttgttattaagttttgattggatgtcagtcattgtgaagttttatgttgttgagcacaagattttattgtattcctttacggagttctggacttttcttttaaaaacaattttttttgtgtgtgtgtgttatttctggacttttcttctggcacgtatctaagtctcttgacatcagtttaatccttcttgaggcttacatttaaacttttttagggctggtgcagagtagcagggccctaactaaggtgtctcaggtaccgtgagctcactccactctggctggtgggaacgcaaactattcccacccatgtcagcttctggaattgttcagcctacttctttttaatggttctttccccagcttcttgtttcatccgacatatttactgatcagtatcagtcaaagactcaaggggactttacagtagatgtccaagagctctctttctgtgcagcttccccgactcaacaggacagccctcttaaagcctcagcctcaggcagtcagctcagcagggggcctagggaaagagtggccacctttgtctcccttccggcaggaatcacagtcctaccctatcttttgtcccatgtcagaaaatagttttgtttcatatcttgtatcaggttttctagttatgtagagcaggacagtgttctgtgtagcagtaatttcttcagacgcaaagctgaaggcccagtggtctctagtgactcagttgacagaacttttctacccagtcgctatccggagtcacacttgggtgctgcatgagcagcacaaggaggaagcagagtggactcaccattttcagggttttgtttttcatcgcagaccagttcaccagggtaattccatcctggtgtctgccatgaggttccctttctttactgaatgttggcacttacaaaaacgttacctgtgagtcattcggctctagcctagctatttttacatctgtttttctaaattgttcctctacccccttgagaagatcattgagtacctgttggcaaagatgtgtttcatgcatctgtttggaatctgtgattaaaataagggagtgtttttcttaccttcttttcagactggcagtgtttcctgttgagaggggtttcatttccttagggaccttgctccacacacagcagtgcaagccaggaacaccagatctgcctctgggtgagggaacctgctctgtccgcactttgccttttgggtatttgtcacgcagggttttcagagaggggcaggatggccctgtgtggtgtgtggacgccccacattgcactgtgaaagcacagatggaaagggtggtttctgctgtcttcaccttcctttgtgtgctccccttttcctgactatcacaaaggactgatctcaagtggttcccaagaccatggagcaggacattctcttcctaggaagtgggaattatttacctaaatccacatgtagggaacacagttgctaaggactggggctggataacagacagacttggatttgaatcccagctccacctcttattggctgtgtaacctcagattacagacttaaccaccccatgctctacttcctcattataaaatagacaaaagggccagcctgacgcctttgctgaggagtggggagcgatgcaagtgagagtcctgatggggcatctgtgccactgctggggtggccagaagtcctggtttgccctctgtctcaatatgatgaattaataatatccccgtttattctaaaaaatgtcctggtatccacagcaaatcaaacagtctccctaattataactcagcaagcgttagctattctcagaatatttgttctgactgtatccatgttaactatttttattgttcagtcaagccagttttgagggccactttggcctctgacactaaagattcaaagatgaatagaccccacttaggcagagcagttagcgaacactgggcttgcaggggatgggagagagtgacactctgtcaaggtgagtcacagaggaggggactttgggcttgaaggatgagtttgcaagattaatcatgagataacactttctttctttctttctttctttttgaggcagagtttcgctctgtagcccagtctggagtgcagtggtgccatctcggctcactgcgacctctgcctcccaggttcaagcaattctctgcctcagccttccgagtagctgggattacaggtgcccaccaccacgcccgactaattttttttttgtatttttagtagagacagggtttcaccatcttggccaggctgatcttgaactcctgacctcgtgatctgtccgcctcggcctcccaaagtgctgggattacaggcgtgagccaccgcgcccggccaacataacactttcttaagatgttggcatgggccaggcgcagtggctcacacctataatcccagcactttgggaggccaaggcaggtggatcacgaggtcaagagatcaaaaccattctggctaatatggtgaaaccccatctctactaaaaatacaaaatattatctgggcatggtggcacgtgctggtagtcccagctactcggcaggctgaggcaggagaattgcttgaaccagggaagcagaggttgcagtgagccgagatcctgccactgcactctagcctggcgacagagcaagactccatctcaaaaaaaaaaataaaataaaaataaaaagatactggcatgaagttggccaaagatagaatgtatggtgcagtgctcttctgcacagatatctaaggaattccattgcagcactgcttgggagagaaaaactggaaggaactatatgttcatcagtaatggaaaagatcaaattccagtccatttgcactatggaatcctgtgcagctacttaaaaaatgaacttgacctgtctgtactgccatggaaagaatttgacatattgttaaattttttaaaagtaagttgaaaaatcaaactctcgcccattcaagaaatacttattaaatgtccaccctatgctgagaactatccttgctgttggggctacatttataaacaacacaagatcagtttccttttcttgcagaagaaagccagaatttaagcaaacccatacaacaattccaggtggcaagaaatgacaagaagagaaattaaagccatgtgacagagagtggcatgtggtagagaatggatgggatctcaggcagtcagggaggtctcccctggaggtggcactggagcccagacctgtgtggcgagaggagccagcccagggacgctctagggaaggagggttttggcagcaggaactgcaggagccaggggtctgaagatagatgtgcgggagtgtggcatgctccaggaagagaaggaagaccagtgtggccaggacgctgcctcacaggttctgcaggcctgagaaggagctgggtttctagtatatgcaccacgacaagagagttggaagcccttgaaaaaaaatcactctgctggtaataggcaccatatatgtgataggatcctgtttattactttagttttattttattttaattttattttttgagacaggatcatgctctgttacccaggctggagtgcagtggcacaatcacgtctcactgcagccttgacctccccaggtttaggtgatccttccacctcagcctcctgagtagctgggactataggcacgtgctaccacacccaactagttttgtattttttgtagagccagtctcactctgttgttcaggctggtctcaaactcctgggctcaagcaatccacccactttggcctcccaaagtcctgggattacaagtgtgagccaccatgccaagcctattactttaaagataaactttataatcacatggtaaaagaactggcagtctgcatattgaagtgttaatagtagttaagagtagttacgtctgagcgggcagtatgaatagattgtcttttactctgtacctcagtgagtctgaatgttttatggcaaaatatgtttattattgagtaattaacacagcgtactcattacggtttcactcagccctcaagaagtatgttatattttacatacagtaaggcacggtacagtgtaaattgtaccatgataccttttcactgccttttggacttgaatcccatactgtcttcctttattacatctagaacagtggatgtaaccataaacagaagtggatttcctctctccctttcttttctgccattcttccttcaggaggctgaacgcttttgctgcatttgctttcttaaacgattttgcctaattcttaaaggaaattcttccttaagcgtattttttcaaataccatgccttttacctcacttaaaaaagttatcctggtttgcaccaacccccgcttttgtgtttctgtagcctgctccactggccgcagatgagggtgatgtgggtggtggagagtcccctttgcttctggagggcatatgaggcagatacttgagccatccctctggcttttgtgcctgctgctgaccctctttcctttcgcctagaactcaaggtgccctgaccccacactagcccagggtaaagccctctgggattgtccagatggcccagtgccaacagtgggtcaggtgcacaggtggcagctgtggtccagtctcagcccccagacagggcttacttatccatatagaaaaatccaaaatgtttgaatttgttgccatccttaaagatggagatttcctgtaaggaaaaccagaaggaagactggtccatgttagatcctcagtcccacagggctactgtcagcctttgtagacaggctgagccgagactgcgcctctaatcccagctgcttgggaggttgagacaggagaatcgcttgaacctgggaggcggaggttgcattgagctgagatggcaccattgcactccagcctgggtgacaagagtgaaactccatctcaaaggaaaacaacaacaaaaacactcttgagcttcaaagagccctaaaggagcaggtaaagaagtctcctaccctctcattttccttcgcccaccatgtcaggtgtgtcttacaggaagcatggctggaatctccctgtaggggaaactgaagagcaaaggcatttgctgtttcctaagagggttaggagatcaaatgtccagctcctgctgtcactcagccagcccatacctgctggggcaatacaaaaaagtaggtttcctatattttgtagggtattgtgttacagtaagcttagcagttgacaagtctgtaatacagtgctgtgattttcacccttttttttttttttacagttttttgtttgtttgtttgtttgtttttgagacagagtcttgctctgtcacccaggctggagtgcagtgccgcaatctcggctcactgcatcctccacccctccaggtttaagcagttctctgcctcagcctccagagtagctgggattacaggcgtgtgccaccatgcccagctaattttttgtatttttagtagagacggggtttcaccatcttgaccaggctggtcttgaattcctgacctcgtgattcacccgcctcggcctcccaaagtgctgggattacaggcatgagccaccgcgcccggccgattttcacccttttatacgtggaaagtttgccagatagtcactgtttccacaaaatggcagaagtgaattaaaactttgcttttaaagtttgacttggaattagtatatcttggcagcttatttgatgattttttaagacaatctcagcttccttacatgaaatagagacccctttcctgctccctatgcagggagatgctgagaagagacctgtgagttcctcaggagtgactgagggcagcggacgaatgtcgaggctcaaatcctgtgtaagcacagaaggttgtacacaccctcgtgcagggctctgaagaaaagatgcattacctttttaaataacagtagttcatgattatgggaaaattcaaagttaaggaaaagtattttaaaagtccatcaaaatccacacatttagctgggtgcagtggctcacacttataatcccagcactttgggaggccgaggcaggttggattgcttgagctcaggggtttgagaccagcctgggcaacatagtgaaaccccatctctacaaaaatacaaaaattagctgggcgtggtggtatgtgcctgtggtcccagctacttgggaggctgaggtgggaggattgcttgagcccaggagatggaggttgcagtgagctgataccacgccattgcactccagcctgggcgacaacgcgaaaccctgtctccaaaaaaaaaaaaaaaaaaagaggccgggcatgttggcttacgcctgtaatcccagcacattggcacaatcctgaagtcaggagttcgagaccagcctgactaacatggagaaacctcgtctctaccaaaaatacaaaaatgagctgggcatggtggtgaacacttgtaatcccagctacttgggaggccgaagcaggagaattgcttgaacccaggagggggaggttgcagtgagtcgatttcacgctattgcactccagcctgggcaaaaagactgaaactccgtctcaaaaaaaaaaaaaaaaaaaaaaaagaatccacacattctccatacacagattcttaggctcctttctgccccccagagtggtttgcttgccacccttatatagtcatccctcagcatctgtggaggatcagctgtaggactccccacgtatagaaaattcataggtgctcaagttccttatacaaacggtgcagttggccaggtgcagtggctcacacctgtaatcccagcactttgggaggccgaggtgggcagatcacccgaggtcaggagtttgagaccagcctggccaacatggtgaaacctcttctctactaaaaatacaaaaaattagccaggcatggtgatgcgtgcctgtagtagtcccagctactcaggaggccgaggcaggaggatcacataaacctgggaggcagaggttgcagtgagccaagatcgcacgcactattgcactccagcctgggtgacaagagcaaaactctgtcccccccccaaaaaaaagggtgggggggtagtgcagtgggccctcaatagccacaggttccacatctgccaaccctatccctggatgtcagtgatggtccacacctttttatctttggtgctgtgaaggggactttacatggcttattttcactcaccctcctaacagttctgtgagtggctactattagtcccactgtacagaagcggaaactgaggctctgatgggggatgtaatgtggctcaaggtcacccagctagtaatgaggctgccagagcgaagggacccatagtattttttctgaagcctctgggaggcttcaggaattcatttattttcctttttcttaaaccctctaatgctctaggccccagggccttgcaggcattgtgagatctgagttggggatcacacggcagtgctttctgttctgttctctccctctctaggcatcatggccatccttttctcaggcatcgtgatgtcccactacacgcaccataacctctccccagtcacccagatcctcatgcagcagaccctccgcaccgtggccttcttatgtggtgagttctgcttctgtgtggccgtgagcaggcccacccagagctgatcttgcttccttatcctgtttgagaagtcagttgagactttccctggcagcagggcagcagctcctcagagccagatccctcactcccttatcttttgtttgttcctctggctttgaaatttcataaagtaaaccaaacacctaataaatgaacatctggcgcctacaatttaaagaccaaaaatagtgagaaccaattatgaacatttgatacatgcatttttaatgtattaatgtgacatttccaaaaatgtattccttggaaataaaatattaatgatggtttggtgaaaatggctccatagtcaagcaaggcatggggctcacacctgtaatcccagctgcttgggagactgagaggatcacttgagcccaggagttcaaggctgcagtgggctatgatcttaaaaaaaaaaaaaaaaagaaagaaagaaaaacaaagcttttgtagtcaaacaagagtttaggaaatcctggttaaataaagtttaacatttatgaattgccagacttttcagcaaataatggattgtcaaatccttaacgggggatatagttatagaattttccaaacttgtccacagaatcctttattcacaagagcagcctgagggacatcactcggggacagttcgcagtagaggtgtcatttgttgggctgggataaaccacgatggctttgtctttaagcagtttgttcaagttcttgttcccccacgctccgacatacccatgtatctccccaccaactttatacttggaagtggttggagtcggggaacagctctcaccatgtccctttaagctggcccccaagtgactttgccctagctgtcatcaaaatcacccctggcattttgagggacttgtctctttttttttttgagatggagtcttgctgtgtcgcccaggctggggtgcagtggcgtgatctcagctcactgcaagctccgcctcccgggttcatgccattctcctacctcagcctccggagtagctgggactataggtgcccgccaccatgcctgactaattttgttttttgtatttttagtagagacagggtttcaccgtgttagccaggatggtctcgatctcctgaccttgtgatccacctgcctcggcctcccaaagtgctgggattacaggcatgagccaccgcacccggccacttgtctcatttttaattgctacttccacactgttagcgtgctaggaggcaaaggcaacccaggcagaaacttcagcagataaggaggctcaggtgaggagtagtcacatgacttgcccatggtctcatggccaagaagtgggtatgcaggccaggtctctttattcctgggccagagggtattatttgtacagcacctctctcagaaagccaggctacagattctgaccctgagcctcccagttaaagacacataaagcaaatcgtccatccaaaaagattctattttgtacccagcagtttggcaaatgttaagtttgataatacccacttctggccttggcgtgtggaaaacaggcctactggaatcttttctggagagtcatttgccacgtctgtctgaatttaaaaggcacgtgctctttggcccaacagtccaaccctgtggaatttagcccatactggggtgtttgttgaacctctcagaaataaaaacagtctaaatatccatccatagaggattgggcattagaaaaattgtcgaattttgacaatttgtcaaatgtgacagaaaaactgtcaaatttctctgcaaataaacattatcccgccaagggaagatgataaacacaattctgcctgtttactgaacaccttcattagcaagggtcccaactgtggcaaagtggcagaaattcagagcaaatggataccgtgatgtatccagatcctggagttgatgctgccagggaaaagcatccactagatctgaatgtcttctaaatgtgctcatttggaaagatcacacaaatattagataagaaaaaaatttcagagagagaagggggggtaaattctccagcttgtggacttgttttaaacttgggtaccattcaaaggaaaaacattgttagaatgtaaaacagccttgctgtttgtgatcaactattttaaaatacagttttaggccaggcgcggtggcttatgcttgtaatcccagcactttgaggggggccaaggtgtgcggatcacaaggtcaggagtttgagaccagcctggccaacacagtgaaaccctgtctctactgaaaaaaaaaaaaaaaaaaatagctgggcgtggtggcgagcgcctgtaatcccagctgcttgggaggctgaggcaggagaattgcttgaacccaggaggcggaggttgcagtgagccgagatcgtgccactacattccagcttgggagacagagtgagactctgtctctaaaaaaatatatatacagttttaatctctttagtcattatgctgttctgagggccatcacagtttaagcagagagcctagtgttagaaatttataaggtgctttttcttaatatatacaagtttgtgtgacagagagtaaatattgggctctttttggctcgcagagtggagccaggagttagcaatgagtctcactctgcaaatcctgctgggtgtgagctgtgttctaaaccttgtggcagtgttaaatatattaagctaatcatgtggaagttaaccagaggccccttcacatttgtcatgtggcgtctgcagtcatttgctctgaatttttgccactttgccgcagttggggcccttgctaatgacagtgttcagcagattgacagattcttgtgtttatcatcttccctgggtgggatcgtgtttatttgcagaagtatttgacagttgactcattacattaagagatttctgaataccagggacatgtagcttatgtaatagaaaagaatgagagaatttaagcacaagtttgaccaagatattggctgcaggattttcaagaaaataaggaaagtgttgtattggattctgactgtgaatgtttgcttgcttaatagtttagtaccatattggaatgaaatcattggggttgaataatccattctttggtttgtttcagaaacatgtgtgtttgcatttcttggcctgtccatttttagttttcctcacaagtttgaaatttcctttgtcatctggtgcatagtaagtattttcctttttttttttaaatttaattacttatttgtagatcaataaacacatgttccggattcatttatgtaactgttaactgttcaaagtcaacagctacatagacactcttttgtttaaagtttcttttgttaaaaaaaaaaaatcacaaacatacagtaagggggcaggggtagaattaagtgaataaatatccccagaaaggacttttgcttgttttttaagatttttaatggccttgaatattatggtctttaaataaaagtacaggtttgtaagtttttgtgtgaggaggtaaaagcagatttcaaaattgaatatgtaattgatcataaccatgtaaaaatattatgcacagaaaaaagaaaatatgtaaagaaaatatagccacatgttcacagtggtcatagagttgggatttctttctcttttctgctttttctggataatttattatgtacttcttactgcagttttcttcaaatttgtctatttatatttgtctatttgtctgtttataagatattgttcctgcaacctgggtacttccatctctcagtcagcaagagctcattgctcttggtcactgttatttgtcctccaaactcaggtttcagggcaagagagaagcagcaaaagtcctttacagaaagtataatagcctaggctgggcgcggtggctcacacctgtaatctcagcactttgggaggccgaggctggcggatcatgaggtcaggagtttgagaccagcctggcaaacatggtgaaaccccatctctactaaaaatacaaaattagccgggcgtggtgatatgcgcctgtaattccagctactcaggaggctgaggcaggagaatcgcttgaacccgggaggcggaggttgcagtgcagtgagctgagatcatgccatttgcaccccagcctgggcaaaaagagcgaaagtccatctcaaaaaaaaaaagtataatagcctttagtgtggccactggggaaaagggacacatttgatcaaacctgaaacaagtgtaggcatggaagattggatttcagtgggtgaaacagggaggtgactatttcagccacaggttgggaggaaaatgaaaggatgccctggggtgacaactcagttttctctaagcagttaggcccaggctggccctgcagctagtggagatggcctattcaggtgggttacagttcctgccctgtaaactcaatttagtggtcaagagcatgggctttggggtctgaaccagatttgagacttggatccattacttcctgccttgtcaacttggaccaattacttcatctctctatacctcagtttccttgtctataaactggagacaacaatacctactttgtaagacctttgcaaggatttaaatttagcaggataatgcatgtaaaatgattagcatgttgtctggcatagaaatgtttgatgattggaaacatttactcttggccaggcatggtggctcacgcctataatcccagcactttgggaggctgaggcgggtggatcacttgaggtcagcagtttgagaccagcctggccaacttggcgaaaccccgtctctactaaaaatacaaaaattagccgggcatggtagcacacgcctgtaatcccagctactagggaggctgaggcaggacaattgcttgaacccgggaggcagaggttgcagtgagccaagatcacgccacagcactccatctcaaaaaaaaaaaaaactctcaaattcatgcttgttaaaggaataaacttaaagcctaaagaatgtactgtacatgtctatatcatccttttcaagtagttatggtgagaaccaagatgaagaaaatgaaagtaaagtaataaatgtcctaagaatccacttagataagatttaaactttaggctgggtgcagtggctcacacctgtaatcctagcactttgggaggcaaaggcaggaggattgcttgagaccaggagtttgagaccagcctgggcaacatagcaagacctcatctttaactaaaaaattttaaaaagtagccaggcatggtggtgcatacctgtagttctagctacttgggaggttaaggtgggaggatcactggagcccaggaggttgaggttgcattgagccacaatcacaccactgcactccagcatgcgagacagagtgagactttgtctcaaaaaaaaaaaaaaaagatgtaaactttacataaagctgtactttgccaagactaacatgcctttggagatggagaggaaccaaaagccacagcaagcagctggcaggctaagccggggcatgtggcctcctgatagtccctacctctgcgttcctcttgctcagagagcagtgtttccatgcatgggaggtccttcatagctgccctcctttccctgagggagaggcagaaacaccttgtctgtccccctagtcctggtatgatcaatgcagccctgtcccaaggaggggcaccttgggagtcaggttgcccttaaactaatctgtgaatacttctgtacagcctcttggcattcagttttgttctgctgtcattactaaagcccttcctgatacctcgtccgtcctctcttttctggctactaagaaaggtaacgtacaaagctttatcctttcctagatgcatagaatcccgcagctgtggcagcacgcccatgctgggtctctgacgagcatggtgttgctcgtgtcttttgtggctgaggggaatactgcatttgtactggatgtgttacacagtctgcattagcttcatccaagaagcttcagcttgaagagccagatgttttcacctaagacttagtttgttgctatcaacaggtgcttgtactatttggcagagcggtaaacattttccctctttcctacctcctgaatttcttccgggatcataaaatcacaccgaagatgatgttcatcatgtggtttagtggtaagtcaaatcttggataaatggggtggggaagtacctgttaaaagcacgccccatacagggagagctgtggttctctgctagcgcccttggcaaaaccacaagtaatcaatactcccgtttaatggcacccactgcaatcaagatggtgcccctcaccatggtgctatgaagtgggtgaggcttggttggaagagggcaaacaacatgcccagggtcacgtgaccactggaggcagagccgggatttctgccactctcttctgaacaccatagtgcagtccgggatgcagctgggcgtgcttcagcgcctccctgggggtcttctaggctgaagtaataatggtctcaaggtagaaaaggtgaaagttgaaactgtttcataccttatgttagttttggatatttttccttttagtcacaaagttctagtagtttaatttgaatgtttcagttgctatttaatcactttttaaaggacggaaatgatttcatacatctttgcttctaaagaactggatccataggcatccttaaatttatttttgagcaatacatactgttctttatgctttcttgcttaaatattataatcaaagtattttccgtgtgggttgggttatagcaacacactataatgttctctatccaaaggcatatctgcaagtttgtctcagatttctcttctttcaaaaggccatgtttaaaaatgtatatgtttcatatatatgtacgtatgtgtatatatacatatacatttatatgtggtgagaaaaactcatttttttcctaatctcttttgccagtgaggcaaactactttgtaaatggttgcagaagtgtgtcagaggtttttgaagtgatgtgggctatttgggaaggggggcatgaggataagagagcgttatggggaaggttggagtgtatttgaaatggcgggggctgtcggctcctgttctctcccaggctccccgggctcttgctctgtgggtttccatccaggctttcctggatcctcaacgaggggcactgaacaagcctctgctaccggcccctcccatcatcatttaagcaatcagagcttctcctccttcccacaaaacaccagcaacttcagccagagttcctcctcatgtcccccgcagctgtgtccgcacctcttttgccatggccagacccttgcgagtgagccgtgctcgctcattttctccacttcttcaccgcctgtccacggggctggaattggccttggcaggtcaccagtgacctcccgcagccagacctggaggggaggcgtccgcccccgtcctagcctacctccttcccactgcccctaccttctggcgaggaccacttcactctcttccccggcctctgggccatgctcctcctttctctcctttgacgtctccttgggctcgtcccccttcgctgacccctcaaatagtggcttcttcaggacttggccccagccccacttctgttcacgtgttctgcacttcactgagtgcgctcacccgtccactggccttcacttccacctagtcccaaagctgttcccgcgaacccagacctccctctgggatccgtactcctgtttccagctgcctgtttggatgccgtggggatgctgtcatccctatgcctttgcatcccccttgcccaagaaatcctactttgaattgcccggtggcctggctagccggtactaagcacttgctgggtacacaccctgttaaagcacattacatgtcccgtgtcactgaatcctctggcccgtgacaggtttagagaggctgagagtcccttgtcctcaccatgtctctgtattatgtgccctttgctcttgccctgccgtctccccatctgggtctggcctgcagcagcctggctgccctaccccatggtgatgtgagcctccccgctttcctgtctggggaaggtcctggtgctgtctgcaccatgcccccccccaccccccacccccctccccccaccatctcttccaggtagcatttcacaccccttatttgctgtgcctcctcccagctgctctaggagctccccaagggtggggctaggactgcctgtcccctccgtatggcaccaaggaagccaggaaacttctaacagaggaatgtgctgttttccagctcagtccatgcccctcagttgtgccctagtagcgtcacagaggaccagccagcctgtcattaccacctaagcagcccacagccccatcagtgccaccaggggcctccacagggacagcatctcgagataggaggggtactggacacattgcatcttgtgctgttgtgggtattagttgagtggccctgggcgggccatgctgctcttggcctccatccctcatctgtgtgttgtggacaagagtagcgctgctcggtgaggattcctgtgaagatccagtgatgctctgcacactgagcacctgcccaggcctggcgcacacacagggagggctcagcccacagcagctgtcctgcagtttccaagacacgagcatcaggcttgctaagtcctcccgcacccgcatctggggctctgtagctggggcaggccatctcatttgatctgccaatgttggaatggaggtgagtctgtggtcccatctctgccacctgctctttacaccccaaagcctcacagggtgagcacacactcttcagcagggccattagaatagtcagctggtcgtggtgctgggccggctggatttccagggaagccagcccatgaagctgctgcctcttcactgtgtcctctcacactgtttgctgtcacccaggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatggttagtaccatgcgcctgtgggggtggggcagggggctggcctgctacgcagctggtggtccccactgtcaggaaatggggagatgagccttgctttcttgctttgaggatgcccagcacctccacacacacgacacacacacacacacacacacacacacacacacacacacacgacacacacacacacacgacacacacacacacgacacacacacacacgacacacacacacacacacacacacacacacacacacacacacacacaccccccggtcatcccccctgagaaggaggtgacggaacttgagttctgaagcatggctcttggggtgggggtgtctggtggccttgtgacctgccgcagccatgggggctgtggacgaccccatctgctccctctctgaagctccatggggcaccacaggagtctggacctgtgccacaaccacagcagtgcctctgccctgccagcagctgagacacctgtcagggcccaggtttgagggtttcaaaatcctgtcattccccagtatggttttactaaaaaccacctgttgggggcctgaggaggggaggatgtcttgcggtggctgtgagggccgtgagaggggtactcccccaaggacagacatggtgtggggctggaggtacccaggccccagctgtagggagagctgaggttctgcagcctgcccacctcttcttcctacaagccaccgcccctgccaccaggctgccttcccgccctgtcttcaccctcaggacccctgtgcaaagctaggccctctgaccgaagcagaggctgctgtaggctccagcccagagcatcccctgctgatcaccatgcatttctggacatgcatctctttctagttcccgtattctaggcctcagtaactttaatcagtcatcagaggcccaggagtcctcacgtggccatccacggctaacactggagtcagggctggcaagaccatggcctccaatctccatgctcagctgggcccctcacccagtgcagtgctgctgggaggaaacttccagatggctgtgaggcctggctctgcagaacttccaccacactaagaggccctttgcccccaccccctatctaccaacttttttgtttttcacaaaagctctagcttaggcctttctgggtatcagaatcggtggggggcttgctacacacaggctgctgggtctcacaccagcatctcataggtatggtatggggtccgaaagaatttgtgtttcttcttatttatttttgagacagggtctcactctattgcacaggctgaagtgcagtggcgtgatcgtggcccactgcagcccagacctcttgggctcaagcgatcctcccacctcagcctctggagtagttgggactccagacaggcgtgaccccacccagttaattttttcttatttttagtagagatggggtctcaccatgtggtccaggctaagaatttgcgtttctaacaagttgccaggtggtgctgctgcagctgatcctgtgaacacgcttggcgaagcacagcactagcagaaacaggacagctcctctgaggatgaaccgctgagtttctggaatgttttctgtggcagtcagtgtgcttgcgttttccttggatgatctcagattgtccccatagcctgccagaaactggcgctttcattatacccactttgcagatgagaatgccgaggcaccaagagaatcagacagctgtgggcacagactcccgagcctgtcctctttactaccacgctgatcagcagtcctcaaaatgggctccccagactagcagcatcactggaaacctgttagatctgcagattcccaagcccattcagacctactgaattagcacctctgcaggtggctgcggtgggctcagtattttgtggtttcacaggccccccaggtagattctaatacagaccagtgtttgacaaccactgcttcacagcatctaaatgccctcccctccccggccatcctctgccctccctgcacctgccccgtccccctccccaccacctgcagtgaagctgcagagcacacttcactgtggccccactgagactcctccagcagagcaggcgctgcactcagagcctgtctgctttgctcctacctatgacccgagtcccgcctctttacctccgtctctcccctccacatggggtccttttcttcgtccctccccaattcctacaggatgtgttcctctcccctctcctctcttgacttgattggcaaaagcctgtccacggtggagtcctagctaatagagccacaggcaaagagacaaaaagcctccctgtgcgatttgctgctaatgaaaagcccagaacagcagttctggtcctggttgcatgatagaatcacccaaaagcttgaaaagcttaaagaccaagccccagcctggcccagtccttctgttttagctgtcctaggtggggtcctgggcatccattgtgccctgatggacgttcctgcctccctgcaggctcccaggaggccgtctgctgcccgtcaccctgcattgatggtcaagtggagttagggttggggacactggcggcctgggtggtgtgggggcttccaggaggtgccccccgatggtgccagctggtggccgtcgggccgcctttcctccctgctcagggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggtgggataccggccaggccacactttctgggggtcccttgcctgcctccttcaggacctgcggtggcccagggtggggtggaggaagagtggggaggcaggaaagctcacgtgggcccgccaggccgccgcctcccgatctggaggctggacgtgcttgtggaactcggcatctgctgtttttccttcgctgccacatttagtgcgaggttaataatagatttgttaacacagtttggttttcctggatgatagactcggggtattgatcagctactgaatcggagctgaggaatttcagacataccagggcctcaagctgtggcccaagtctgcccccagctcagggctctggttctgtccctcggggcactgctggcctctctttagttggaggccttgggtaggggtggggctcttcctgctgctgcccgctttgtttccgagcaggcccattttccactctccggcaggcctgagagctgccggtgtgtgcgctcttccaggagccaggcagctccagtgactgtgaccacgaccgcttccttctccagcatcctgtgcagtggatgcagctgtgtccctgacagctgaggagatggaggcctaagggggtgcagtaaccccgcaaggtcacagccaatatgggcataactgggagcagagctaactgtgtctgactccagagaccacatgttcagcctcaagccatgctccctcctcctttctgaatgacacctcccgtgacctccacccccacaaagaacaatcccagctcagtttgttcaactgaaactgaagttgcctgtggccatcaccctgcctcccacctcctccctagacaccccacacaaaacacccagtagcatcccctcccttccatggccctgcccctgacgccctgacggcttggttgtgtctctcgacccaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggagccagtgtctgtgttcatgttcaggtggctttgcagatgcacaggtcacacctcctagactgggctctgtggcacacagctacccagcccctgggccggtggcagccatgtcaccaggaagtacagtgcttaggagcagggctgggtcaggctggcctgcgtctggttcctacctttggccctcagtgaggagcatgtgaagctcagcccccagccaggctcagcttctcctcacgatgctgggagcccttcctccctgggttcgctggctgttcgcccaggctgcagggccgcctgacctcctgctcggggcttacagatcagtcccccacaggcctttgcctgatggtgaaatggggaaattctgtcactgaacctgccctgccgcaggagcgggggcatccatagcctctgatcagaagtggtggcatgtggggcaagaagggtcgtgagttcatctatacccccacgtacttccaaaggcatccaagctgctgaaggtaacaggcacgaaccaaaaatgcatgtgatgtaaaatgaaaccagtcaggagaagctgtcctggccccagccagggggcaagagctgagtttcctggttccttcccacactgtgcttcagcccaccccaggggagactcccgaggccacagtgggctccccgtggcccgcttttggtggaaacccagattcagagaaatatttctccaccataataaaaactgcaagtgtgatgagaagtggtagctgacacttggcctcagtgtcagggaggcaccacgagagtgataaggactctggctaacagcagaattttccaggccagccctgcctgcgagggcggctgggaagtggagctgcgctgtgctgagcagagtgtcagctgggacggaacggagtgctggcagcaaaggtggggggtggtcctgagtgggcacctcgttcccacggaacagggtatgtttcatttgtatttcaaccttctcaactcctaaaaaaagctctcagggtagaggggagcaatcgaggcaagaaatattttccttagaggctagaaagctggcggggggttggagggtcacacacaaagttgagggtcctgtaacccccgcttattattccacagggcactaggggaatgaagctggcctggagcggggccccactgcctcttggaggcaacccccccaccccaagcaagggacaacacagccctctggctctagccagagaagatgtgagacatgaagggcagtgggggtcaggggccaggggccagtacagtcatctcaaggccctgggtgacagtaagtgccccgtaaatgagggtcctctttgtgaatatttatggacctgcaggagagcaggcaggcatcagccacactccccctgcctggggaggccgcctggcagacctggggggtcttagcatcagttgggaccagtctggtgctggggacagaaggaacctctgcgcatacaggcagctgccagctaataccctgatgtaaatggggaagaaaataagtctttgcttacagaaaaaaaagggcacaaaaatgtagttggttcattttgtggcgaagatgagccatacgctcctatctgctggtgggagggcagctggctcacactctccagaggacactgtggtgacagctctccaaagcctgaaaacggcccagcagttccactcatggggcaaaaggaaagtgcatgaaaaccgcactccaagaatggtcatcccggcaatatctgaatgaggataaatggaaaacaacttccttgtccatgaatgagggactggtgagataaatgatgatagaatatttaccaacagctcaagattctaaggatgtggaaaaatgtttagaatgttatcagaccagcattttaccacctttagggagagagaaacatttcaccctctccttaaatgctgtttgagattttaaaatgactaaaaacgaaagtagaaattttagtacatccttttatacaaatacacatactggcactccagcgcgcacccattcatccctaatatggaagacctggtggttcctttcaaccaccacttcttccccgagccctgttgtctttgctaagagaacccatgtggttcgtgtaatgggtgactgtatgcttcaaggggaaacagagccagttctcggttcaggttgttcctggtcattccctctacttgtctgagattggctgaggaatgggtctgtgaccttatttggcaggagaatgaagcgattaaaaaaaacaaaacaaaacaaaacaaaacaaaaaaaaacgaagtctcgctctgtcgcccaggctggagtgcagtggcaccatctcagctcacggccactgcaatcttcgcctcgtgggttcaagcgattctcctgtctcagcctcctgagtagctgggattacaggtgcccgtcaccatgcccagctaatttttgtatttttagtagtgatggggttttgccctgttggccaggctggtctcgaactcctgaccccaggtgatccgcccacctcggcctcccaaagtgctgggattacaggtgtgagccaccgcgcctggcctgaagcaatcttttgaggaatttctaaaactttccttactctcaaaaagacactcaaggaagggacatgttctcttcccattgtctgacctttgcctcccattacttgaggatgtaatgcctccacctgctgcagccatttggagaccaggagggaacaccttgccaccatgctgaggatggcagagcagaaagacagaaggcttgtatgttgtcaaggacactgctggagcagttaattaaccagtcctggaactgacctccctctggatctcatgacatggggcaatacatgttctgtatctgccatttctggttgggtattttgttacaacagaaataatgctgttataacttcatgaactgagaaaagcagatttcagaaccatatcaatagatgtggctctataaattaaattagcagtatgtgtatacaggaaaaaaatcttaaaggatagacatagagttttaacttaactttggttctctccaagtggaaggattataggtaaatttttttttttttttgagatggagttttgctcttgttgcccaggctagagtgcagtggcacgatcttcgctcactgcaacctccatctcccaggttcaagagattctcctgcctcagcctcccaagtagctgggactacaggcccctgccaccacgcctggctaattttgtattttcagtagagacggggtttcaccatgttgttcaggctggtcttaaactcctgacctcaagtgatccacctacctcagcctcctaaagtgctgggattataagcatgagccaccgcatctggccgattataggtaacttttaaaatcttgctgtttgcatatactttctatttctctcataaagaatatttattaagtcaataataaggaacacacatgttctttgaccagaactagaggagcagtgcattagatggagtgacttgaaggcccctagggaaacaggtgagggtccaaactgatgcagtcaccacggagaggcctgtggcccttccacccacgattcctcttctagccctggggcaaagattggcaaattactgcctgtggcccaaatccagcccgcctcctgtgtctgtactacctaagagctaaaaatggttttaacattttttaaaggttggggaaaaaaacagaagagtaaggccaggtgtggtggctcacacctgtaatcccaacactttggaaggccaaggtgggaagactgcttgagcccaggagtttgagaccagcctgggcaacatagggagaccctgtctctctatatataattaaaaaaaactagccagcatgttggtgtacacctgtggtcccagttactcagaaggctgaacccaggaggtcaaggctaaagtgagctgtgatcgtgccactgcactgtagcctgggtgatagaatgagaccctgtctcaagaaaaaaaaatcacagattcacaagaagttgcaaaaaagatagtacagaaaggtcccatgtacccttccccccgttaccctcagtggtaacatcttgcacaactacagaatagtttcacaaccaagaaactggcattgccacagtccacagatcttgttccaacttcattagttttacaggcactcgtgtgtgtgtgtgtttagttctacgcaattttatatcgtgtagattcgcataaccaccatcacagggaagttgccttttatagaagtattccagctgccaaacaaagaagaaatcattgaattggaatatctctattttgtaacttccagtgaaataatggatctaagtgggaagtaacagccttaatagctgctaattccccaaagggagagaactcgacataatatgcctcctgatgagagaatacgcatcaagtattcttaccacagagatcagacccaaatccaagcaaaccccaacagccagctaccatgcaatacatgcacacattcaacaccctttcacgatcaaaacactcaaccacctaggaatagagggaaactactgcaacacaatacaggccatctaggataacagctgacagcatactcaatggtgaatgactggaagcttatcctctaagatcaggaacaaggcaaggatacctacattcaccacttcaattcgacgtagtactggaagttctagccagagcaattaagcaagaaaaccaaagaaaagataccctggttggtaagaaagaagctaaaattatctcatggatgacatgatcttatatgtagataaccctgaagattccacaagaaaaaaactgttcaaactaataaataaattcagcaaagttgcaggatacaaagtcaacacacaaaagtcagctgcatttccataaacagtggacaatcagaaaaggaaattaagaaaaaaatcccatttataatagcatcaaaaagaattaaataggaataaatttaaccaagcagcaagaaagacttgtacactgaacactataaaacatgctgaaagaaattttaaaagacacaaatagggccaggcatggtgtctgacgcctgtaatcccagcactttgggaggccaagacctcccaaatcacttgaggccagaattcaagaccagcctgggcaacacagtgaaaccctgtttcaacaaaaaaaaattaagaattagccatgcgtggcacatgcctgtggtgccagttacttgggaggttgaggtgggaggatctcttgaaccaagagttcaaggctgcaatgagccatgactgcaccactgcactccagcctgggtgacagagcgagaccctgtctcaaaaaaacaacaacaaaacgatctatactgcccaaagtggatctacagattcaatgcaatccctataaatggcattttttacagaaatagagaaataaaaccatcctaaaattcatatgggatctcaagggaccctgaatagccaaaacaatctttaaaaagaacaaaggtggaggcgttacacttcatgatttcaaagtatattacagagctacagtaatcaaactagtgtggtactggcatgaaaacaggtatacactcatagaccaatggaatggaatagagagcccaaaaataaaccctcacatatatggtcaaatgatgttcgacaggagtaccaaaaccactcaatggggaaaggactgtctcttcaccagatagtgttgggaaaactggacattcataaggaaaggaatgaagttagacccctaccttattctgtatacaaaaattacctcaaaatagataaaagacctaaatgtatgacccaaaactataaagacaacttaaggggaaacttcatgacattggatttggcaatgatttcttagatattataccaaaagcataggcagtaaaagcgaaaatagacaaatgggattacatcaaacttttttttttttttttttttttgagacagagtcttgctctgttatccaggctggagtgcagtggcgcaatcttggctcactgcaatctttgcctcctgggttcaagcgattctcctgcctcagcctcctgagtagctgggattacaggcatgcgccaccacacccagctaatttttgtatttttagtagagatggggtttcaccatgttggccaggctggcctcaaactcctgacctcaggtgatctgcccacctcagcctccgaaagtgctaagattacaggtgtgagccatcacgcccagccgactacatcaaacttttaaatttttgcacatcaaaagaaataacagtatgaaaaagataacctatggaatgggagaaaatatttgcaaatcatgtatctgataagggatcaatatccagactatataaagaactgcaaataaaaaacaaaaaatttacccaattaaaaagtgggcaaagggctgggcacagtggctcatgcctgtagtcccagcactttaggaggccgagataggagataatttgagcccaggagtttgagacaagcctgggcaacatagagagatcccgtctctatttttaaaataacaaaaattaaaagtgagcaaaggacttgaatagacatttctccaaagaagatatataaatggccgaaaagcatatgaaaagatgctcaacatcactaatcattagagaaatatgaatcaaaacaataagatatcatctcaccccattaggaaggctgctataaaaacaaacaaaccccagaaaataacaagcgttagcaaagaggtggagaaatggggactcctgtgctgcaggtgggaatataaaatggtaccgctggccgggtgtggtggctcatgcctgtaatctcagcactttgggaggctgaggcaggtggatcgcttgagtccaggagtttgagaccagcttgtgcaatatgatgaaaccccgtctctactaaaaatacaaaaaaattagccaggcatggtggcgtgcctctgtcatcccagctactccggcgactgaggtgggaggatcacctgagcctgggaggtcgaggctgcagtgagctaagatcatgccaactgtattttagcctgggtaatcggagtcagactctatctcaaaaaaataaaatatattaagttcaggtgtacaataagaaaattaattaaaatataaataaaaatgataaaatgggtacagctgctatggaaacagtatggagactcctcaaaacattaaaaatagaacgccgtatagtcctgcagttccacttgaaccgcctcctcctcctcacataggacctgaaatatgttaccagtggagattcgcatgtctgaaaacctggacctactcccatcccttaagctcacccctgccttaagtgatttcctctcatctctcatttatgaagctgcagccttgaatcattcccataagaagtatttatttttctacttttgcacaatatgtgcaaataaacagtaggaaattggaggtaaacagagagaacaactactcccagtgctaaaacaacaagcaggctgaagtaaacatttaggctctggcaaactctaaaggacaaataatccagtttcctcaacaaacacgtcgcaagaaaaaagttagatgtgaaggtaatactgtctcagcctgttcaggctgcaaaataccacagactgggtagcttttatacaacaaaaatttatttatcttagttctggaggctgagaagtccaagattaaggcactggtagattcagtgtctggcaagggcccaattcctggttcacagacggtcagctcgctgggtcttcctgtgctgggagaactccattctcttcagccccttgtaagggcacccatcccattcgtgaaggccccacccacatgacctaatcagctcccaaagtgccctcctaatacaagcacactggggggattagatttcaacgtttgttttttcttggggggacatatgcagtccgtagcaggtatcatgttttaaaagccctcgtctcttagataaacactgaaaaattcacaaatgagacagacatctagaatttgcttcagaagagttcaggagtaggaaagtggatggcaagggtagagacaaaaccagattggccacaagttggtaactaactgttcaattgctgaagctgggattcattatactagtatcacttttttgctttttttttttttttttttttgagacagggtctcactctgctgcccacgctggactgcactggtgccatcacagctcagtgaagcctggaacttctggcctcaagtgatcctcccacctcagcctcccaagtagctggggaccaaaggcatgtgccaccatcccagctaatttttttttaatggggtctcactatgttgcccagattaggcttcatgtcttttgtaaacaaaaaggttttaaaaacagacaaattaggccgggcgtggtggctcacgcctgtaatcccagcgctttgggaggccgaggcgggtggatcacgaggtaaggagatcgagaccatcctggctaacatggtgaaaccccgtctctactaaaaatacaaaaaattagccgggcgtggtggcaggtgcctgtagtcccagctactcaggaggctgaggcaggagaatggtgtgaacccgggaggcagagcttgcagtgagccgagattgcgccactgcattccagcctgggtgacagagcgagactccgtctcaaagaaaaaaaaaaatagacaaattggggcttaagtgagataacagtttatttttcatataacagacctagaggcaggcagcacgggcaggccatgggggcagcttccagagcatcagggccagctgctgtagctgctgcccaccccttcctcgcttggccccctcagcttcatagagcagctccatctccagccatcacagccattccagccaggaagaagggctgggtgggaagggcaagctcccttccttgaaggccatgcccagacaccacacaaagcacctctccatccagggaccagacagtcatctgaccacacgtggctgcaggaaaggctagggaaggcaatctttactataggtggccacagatttgaaaaccggggcttctactaccaagggggaggggatggagactggggtacgatttggtgtctgccacagctctcatccctgagattggtaatctagcatcctaggtgccacagatcggccagcagagctaatgctgtccagctggtgggcccaatgaggtttaaatatgtttgtcatttacatgtacatgtaatgtacatgaagcaatctgctctgaagtctctgttcccttttggatgcggagcaagcacctggcttccttagctctcccagggtaggtgtgcgtctccaggaaactgctacccccgacagccagggtggcaatgccgtttcctatgctatagctcaaagcaatccagcacctgagcctggctttggcccaaggcctgggtatttgttcagccagcaaatgaaatggagaaacctgttcagtgtctgccctgacagctgagctgcctggtgggagcccacacagcagcgtggtcagtgggtgggcacaggcctgctgctgctgccttaagatttctgccatgtattttgcttttaagtcaatcctcacttaagaaaaaaacaccttttttgttttgttttgtttttccaagatggagtttcactcctgtcaacccaggccggagtgcaatggcacaatcttggctcattataacctccgtctctcgggttcaggcgattctcctgcctcagcttcctaagtagctgggattacaggcacccgccaccatgcccagctaatttttgtatttttagtagagacggggtttcaccatgttggccaggctagtcaacctcctaacctcaggtgatcctcctgcctcggcctcccaaagtgctgggattacaggcgtgagccaccgcacccggcccttaaattgatttttaaagcaaacctatcactgttacaatggaaaagtagtatggcctgccctagaaggtaacaaaacctggctaagagcctgccacacgctgtgtctgatgccaggtttctctgttaaagacaaggtagcatcgaactgactccctcctcaagacagttaaatggatggaaaaaaattcaaatggaattaacttttaaaaaacatcttccaatgttattaatgcctctttgtctctactaacaagcatttctcctggatgatgcagtcccctctttgggaaacatctgaactctgtgtaccgccatttccccatatgtaagatggagatggtaacagtgcctatttaataggatgactgaagctagtaagtaagatcatgcacatagtctcaggatacaaatgcctggcgggaggatcactcgagcctaggagattgagaccagcctgggcaatatagtgagaccccacctctacaaaaaattaaaattagccagacatagtggtgcccacctgtagctacttgggaggctgaggtgggaggatcactcaagtccaagaggtccaggctacagctagccatgatcacacaaccgtactccagactgggaagtaacagagcccgtcttaaactaaaaaaaaaaaacatggccgggcgtagtggatcacacctataatcccagcactttgggaggccgaggcaggcagatcacgaggacaggagatcgagaccatcctggctaatacagtgaaatcccgtctctactaaaaataacgaaaaattagccaggtgtggtagtcccagctacttgggaggctgaggcaggagaatggcgtgaacccaagaggcggaacttgcagtgagctgacatagcgccactgtgctccagcctgggcgacagagcaagactccgtctcgaaaaaaaaaaaaattttttttacaaaaaattaaaaaaataaaaagtgccaggctcgcagtatagcactcaaatgctatttgtcagtttcatggaagagaaaatttaagtcttgtcattaaaaaactaaatacagcttaaggaaaaataaactcccaagtaaccaaacttcaaagcagggccaggggacataaaaccccaaacacttcatttaacaatggaagacactttattattattatttttaatcatctctcaacatttcaactcttggtagaaatcaaatgtaaaacatctgcatttttaaattagcatgtatttaactatctcaatcacagcaacctcatccagtaagatgcacacctgggagcagggctgtagtatttcgtattccagtctgtgaccacagtgcgtccgtgatgacaggtacactggactttccctcctaggatgtgttagtcattcctgcttttgtccatagggtaagttacgtggcatcacggttggttagaaagagttagttactgtaatgctggcgcaatctggaaatggaaaactagaaaactagagctctcaggagtgggccaggcattgccgattctgaaatgtgaaaaggaagaacatcaaagatgaatgccctgctaggctggtcttagtaataaagttggttgaaattcagcttaatatacacactgtacatctacatgtgatctaccagatagatatatatatatatatatatatatatatatatatatatatatatatatattaaaaagagagccatagaagatttggaaaaccttaaaatcactcaactgagttggaagaacatcagcaaattcacagtggcctcaggattcagccagacttaaacttgctcaagagctgaataactttctcccagaaaagcccactgcatataaatcccttaacattgtgtacatcacaaacagttatggctaaaatatagttagttcacaaggaagcggctttattttcaaactcttgccccactcctgctcttgtacccccacaaggaaaatccaggggttggtaattcacatgagaagctgaaggggccttcaggcttggaagcgcttaggcttagctgagcatctgaggagccgtctctctgatgggcacatgccgactcctgcccacttttagtgcaaaaagattgcaaatgttgcagatgagtcctggaaactggtgaagagaagaggattgagatggaggggcagtaggaatcccaaatgattttccttctgaaacgagactcaagaagtgtgaagtgcaaggttcctgctcagcaagctataggtccgacaggtgaggtccctgaattgtcataggttagcagtctgcagacacacagacctcgacacccgcgctcaccccctaagtgcacactggaggtaggtgtatagatagttactgcagggaagacagtggctctccaccagctcaagaaaaggaggcttcatgtctgttcctccctgccccaaactctcctctcccctcgggccatagtgagtggaggatacaacacgaatgggcgcgaggccctcccttggaagactaaagaacccagggcatttaataaatagctacataattcatttttttaaccacgttgaaacacacagcaagttgaatatttatttaaaaataaatctcaaaaatatctattgacagtacagtaagaggggcatgtgcaaacaacagaaagggggaagtcagtcctgctgtgggaagcccacacatcagtgtgttggagcaaagttcacgaaggccatgggctgactgagctgtggtgtacgaaatgacattcagctaatactggactcggttcacctttgacacctggagaggtggggaagccagggggtggggagtccagctggggatccttgtgtttaggaagggggcggccaagggatgagcctttgggagaggccccgtgtggcaggagggctcatttcacaagccaacaggcctctagctcgccgctccaggtggatgtttggtgacctgaagggcccttcccagtccaagttggctttgcaatgggaggggtaggtgcagcgagggtcccagagacagaaatcctctttaaaggaaaaaacaaaacaacaaaacaaaacaaaacaaaaccccaaaaaaagaaccaactgaacagggagtggagagattagcaaaatgaatctgaacggaagtgccaccttctcccttgtcagacaacaaagcagccattggttgagatatctgagtcgctaagtgaactcccacgtggacacagccagcccacgatctctgccacctacatggtcaagtgcaggcctccgcctctgagatcaatgcgttagtacttcttcaccgtgaaacccgaaaggtcggttgatgtagcccttggagctggaaggggcgaggccggtctatctgtacacgagatgggagagctgggtggacttgtagttcagctggttgttgggcatgaacttgtgcagctcactctttttgtagcaggggtcataatggtaagcgctgaggcaggcgtcacatgagacttttgaacactgggtgcaggtgttggtggcgcctgggcggttgcagaagccacagcgggaagtgggcgtggtggagggcttggatttggagtgaaggtgcgggaggcggtcgaggccctgagtctggcctgggtacttctcccgcagagatgccccgtgggccaggctgtcatgagtcgaggccttgctggggaaggcgctgggcttggaagctggaggacaggtgagcaggctgtcacagcgctggcagagggaggagctgcaggacagcccgcagctttggcacttggagagggcggactctttggcagggggcgagcgcttgtggtagagggagtgggcatcgtttctgagcagccacacatccggccgcagagcatcctgccgacggtaggtggccctgggttcagagtctgtgtacagatccacgtcatcctgagtggagaagtaggtaccgcgcagcagggccgggccgttgctgggggaggcgggtggaagcacatccgggctgccgtggggggagctggccatggtcagcagcgaaggggatgggcggatgatctcatccttgaggtcgtcccccacatccgttgccacaggctccttccgaagactcaatgaggccttcaggggtggcttccggctctcccagtagctgtcataggcatccactgacctcgagggcttggtcacgcggggcttgtagtagtccttggccgcccgctcgctggccgacttctggagtgccactcgtgacatggaggccgtcaggtgctcccggccctctgcccgccgccgcagggcgtccgagcagccgcgcacatcctctgcactgctcttgcgctcgctcacaatgtccagctcggagtagcccttgtccttcacttgtgagtggatttctagcatctgctcacactcgactttggccagaaagagctcaaaggagaccatcttcacctggagggtctccacgagctctctgagcttgtatgcagtgcccagctcaggtgtgtagcccatgcagctcaggatggctcggatgtcctcttccagtaatgtcgacttgacataataaacaaaagggcccgtgtaggtctagaagggagggagtagaaaagaaaggtggggttttctgtcagagacacaagacagagactatgtcaaagcaaaggatgtccagctctgaagtggggcggcggggagagggcagggcagggaaggatctcgacagcctcaccctgcgggaggcagaagacgcaggagctggggcttgctaagcactcaggaattgtgcaaggaaatgacccagcagctcctttcttttgtttgagacggagtctcgctcttttgcccagggtggagtgcggtggtgcgatcttggctcactgcaacctccgcctcctgggttcaagcgattctcctgcctcagcctcctgaatagctgggattacaggcgcccgccaacacgcccagctaatttttctgtttttagtagagatggggtttcaccgtgctggtcaagctggtctcaaactcctgacctcgtgatccacccgcctcggcctcccaatgtgctgggattacaggtgtgagccaccgcgcctggcagcagctactttgttaaacacaggaagcaaaacctctcgcttcctagtggggcacgaagactctactccatatgaagagagagcctgggcaaacatggctgaataaaggggccagattacaggcagaacgcggtgacaatcagaacgttcctctctggtatttccatgaggggctgagtaacacggcagactgaagggcctggctaggtgacagctctcctgtgccatcccctctcttgattaccactcctcccatggcagaatgaagaagcctggctaggtgacagctctcctgtgccatcccccgcgtggtctgattcaggatccctctctcaattccccctcctcctctactgttcccacttagtacagaacacccctcagcttgctgggaccgctgagaagcttcctaactgctctccccatccctcccacctccccccacccctctacagcctacttcccataccacagccagaatgaccctcttcagatgcaagccagatcccacactgcctccttccccgcctactcagaacaaatccaagccttgccctgggccacaagaccctgcataacctggctgcccctgccttcccagcttctctgcttaaggtgtggcagccgggccagaaacggttcagaggtgatgctggagagacggggaaggttcggagcccggaaggatctgagagcacaggatggatgggatcagactggcatagcctctcaggagggactgccaggggcaggaagagagaaggagggcctgtatggaggctgctccaggacctcaccttgatgcttctgaattccttcttccacgggtagaggaagaggttgatgcccaccgtctccagcatgctgaaggcgccgtgcagagcccgcaggctagaggagctgagcgagcgcaaggagctctccaccacctcatagaactggatcagccggaatcgataaaagggatccaccttgtgcaggctgagcagggttgaggctgccacccgcaggcactcatcgctgccaggccgctgcctgctggtggtggtatccactttgctctcatggaactgcacgtacttccgaaataagtcatccttgaatttagtatccattgaactgggcttccccatccgatcgaggggggctaccttatctcctccatggcttctggattagaggcagggacatcactaaaagcatggacatgttgccgcctggaccagcggagtgctctggaaggaggggaacaagaagcatgtcattcctcgatacggtcgcgcttcggcttcaggtcgctgaggcaaaatgaacagcagaactggcctgggctacactggaccccagcagcacactacagagcatgtactacaagcagggttacaacagaggccagagagagatggaccttgactttgttgtgctcacaaatgaaaaatacgattaatattcctgaaagagaaattcgggtgagtacagcaggagctcctgtcctggtttcgttggggaagggcgagtttaggaaagccctcttgagacagcaacagacctgaaggatgaggagtctgccaggccaagaggccggggaaggagtcgcagtagaggaaggccctgagctaatagtaccagaggctccagacacgtgacgagcttcacacacactaactcgcttactttttttttgagatggatccttgctctgtagcccaggctggagtgcagtggcgtgatctcagctcactgcaacctccgcctcccgggttcaagcgattctcctgcctcagcctcccaagtagctgggattacaggcacctgccaccacgcctggttaatttttgtatttttagtcaagatggggtttcaccatgttggccaggctggtctcgaactcctgacctcaagtgatccaccagccttggcctcccaaagtgccaggattacaggtgtgagcccccatacccagcctcactttttcttcttaaacaatcctaggagagagacgctacaggcagccccagtggaccatgtgcaaactgagacacagacattagaaactgctcaaggtaggccaggcacagtggctcacacctgtaattcctgaactttgggaggctgacgggggaggatggcttgagtccaggagctcgagaccagcctgggaaacacggtgaaaccacgtctctacaaaaatacaaaaaaatttttaagaaaaagaaactgtccaaggttatagaactctcaggaggcagagaagctgagctcagaacccaggcaatctggctccaaagtccatgcccttacccaccacaccctgctttcctgaggcaggaagcctggaacagtaacagaactgcagccagtgaggccgaggccacgagggcaggggcatgaggagaggcagatgccagcatcagcgggaccctcagccccaaggccgcaagagcacattcagaattcgatattttatacaaagagccacgtgaagccactgaagagtttacagcgaggggagagagatacggtcttatttacaattttcaaaagaggccaccgtggctaccggcccctggagtgctgttaccggcctttgacagcctgcggcccctttatcaccagagcgcttgacagccccctgttgggagaggatagaatgttctgagctgggacacaggctttacacaatcttgtcatctgcttagccacttgttagtagaacaggcacagatccagcaatattcttgtcaccacaacgctgggagcgaatccggattaatggagggacactgccagggccaggggagacaacacgcgcagggtcacggacacggggtccaaggccaggcacctgcgagtgaggccagggctgcttctccaggttacttgggcaaattgctccacctccctgggtgtcggttttctcctataaaacggggttaataatagcgcctctgtccagagctggcgagaggattatgcatgatggaatatgaagctgctcagagagccggctccgggaagtccttgatggccattgctgttgtctgaaggtgctgtacccctaagtggacaggccttctctgagtggggcaaatacctctgactgggtggtagatgtgcattttcacatgctctggtcctgctgctcctgcccagaagctccgtgggtgcaggcctgtgaccatcttgctcagtaaggtgacctgtgtgcttcatgtctgctgagtgtgggagacagcaaggggctgagagaagctgcagcaggactgggcctggcatgtgggggactcctttagcagacctgtgttcagctaggaaggtcctacgagcccagcaactatcaggaggtcaacaaaatcatcctcatctcaaagagccagtagtctggctcctccacagattttgtccccaggaggagactcctgggagtactaatggtgcggtgagaggtgggatgtgtagcaaaactagggacacagagaggccactgtctccaacacactgcactgctgagggagcccagtgctacagtgacaaataaggctgaggagtacaggaggcaaacacatccatttaggggccaggtgcgggggctcacgcctgtaatccctaaactttggaaggccaaggcaggaggattgctcaaggccaggagttcgagaccagcctgggcaacatagcaataccctgtctttacaaaagaaaacaaaatccacttgggataaaattctgcttcaggaagattctcatcattcaggcctcagctcaaacatcagcctctagaggtaccaccctatctcaccttcccagttccacactgtcacattctcctacgataaccacaatctgaaactatcaacttcattcattcattagcttcctctctttgtccacccctcaccctccctggtaagctggtaagctcgtggtaagctccataaaggcaaggaccatgtctgtgttgttcaccacgatgcctaacacagagcctgcctgtgcttgataaagtaggtgaaatggatgctgcagccaggcacggtggctcacgcctgtaatcttagcactttgggaggccgaggcaggtggattgcctgagctcaggagttcgagaccagcctgggcaacacggtgaaaccccgtctctaccaaaatttaaaaaaaaattagacgggtgtggcagcatgcgcctgtaatcacagctactcgggaggctgaggcaggagaattgctagaacccaggaggcggaggctgcagtgagccgagatcgccccattgcactccagcctgggcaacagagcgagactccgtctctaaaaaaaaaaaaagaaaaagaaaaagaaaagagaaaaagagaaatggatgctgcaaaggatgtctgcattcacgatgccatcactttagtttctcattggtacctcccaagaatcctgggagatcagctggagagcaaagaaacgggctcagaaagatggcatgaggtacgacaagtagctcaaggttagcagatgatggacccgataatccaagcctggccttctgacttggaacctgtattcctctcaccaccccacgattcccatgtccagcaagcatttctgcagcccccaccctctgcctgagctggacccagtcggggaatggggatgggtgggacaggtagaggacagcaataaaggagacacatcctgcctgcagctctagctggaagagcataccacctagtatcaaagtaggtatgtgctctaacttcatactgttctgtccataaaaaaataaacaatttaaaatgtatattctcttaaaaaataaaaatgcaggccaggcgcggtggctcacgcctgtaatcctacaactctgggaggccaaggtgggtggatcgcctgagattgggagtttgagactagcctggccaacatagcgaaaccccgcctctactaaaaatacaaaaattagctggacgaacacctgtaatcccagctactcaggaggctgaggcaggagaatggcgtgaacccaggagggagaggttgcagtgagctgagatcgtgccattgcactccagcctgggcaacagagcaaaaactccatctctacataaataaatgtattgcaccactggagaggatagtcacacatgcatttaccattcttgacttatctaagagaagctgccatcacgcctctggccccagggtctgttttttggtagtctgagaaccattcaaacacagagacattaagcttccgaatactgctgtaatttttctccaaggaagtcagccttgaactcaaagagactgattttttacaaagtcagccagtctcaagctcggctcagcgtctgctgctctataatcgcaccacagtccacacccttgtttgttgctgaaaaacaataaataaaggaaagggatccaaacagcccagctgatgttcaaaatactcacaataaggacaggaagcctatctaaaacaaatctcaaaccaacctgggtaggtgagggaaaaggcggaagaaagtaaaagctaaaagataattaagggcaagacaagcctggacaacatagttagactccgtctctacaaaaaaaaaaaaaaaaaaaattaggtgggtgtggtgacacccacctgtagtcttagctacttgggagtctgaggtggggggatccactgagcccaggagtttgaggctgcagtgagctatgatggcaccactgcactccggcctgggtgacagagcaagaccttgtctcaatcagtcaataaggaaaggaaagaaagagactaacaattactgaggttctactatgtgctaagcattgggcttcccactttacctacatcatcccatttaatcctcacaactctataaggaaaacaggctcttcccattaaaacaacctgcccaacagagtttgaaagggtcagagctggaatctgaactcttgctgggaggcccttgatgcctgggctttctccaatttacctcactcatttattgttacatcagtaccatttaccaagggattactgtgtggcatccctctgctaactgctctgtgaaaaccaatgaaatccacaggatagatccaaggttaaagaggaaactgaggctcggagaggccaactcacttaccctaagtcgtaaggctaggaagaagtggatctgagctctgaacctaggtctaacgccaaaactccgactcttgcaaagccatcctgctgcatctgctggacagctctactcgaaagtgtttggctaagttagaatgccttatggcggcgcgagcagagttgagttacaaaaattcctgtagtagcaaaattcccatcttcccacaccgaatggggctaggagagctaatctctatatgatgtaagctcaagggccaaggaaagaggctggtcagagacatcggccagtgatgaagcagctgacatcatccctgctgaaaacattttctgagaatacaagatgccttgtagctggtcatagctggtgttttttctgagcacagagccagcaattcattcccagcactctgcaagaacaacaaaatacgctctctgcaaaaacatcgtggttacaggagaccgagacagcccagcgacagaagctgctaatttctccaagcaacccaaggattggaacgccaagccgtgccagtctggtggaaaaaaaaaaaaaaaaaaacccaaaaaacaaaaaaacagcactgtgaatatcctgaacacagagacaggcaggtgcccagagtcaacggctccagtcagcacctcctgcacccacaatctaggtaccttcttgaaaagcaagtcaatggaaaaagagatattgcacagtcagggagccagtggcttctttagttattttttgaacatctaagaggaaagctgtatctgtttagagtcccactgcatggaagtgaagtgattccgagtagctaagcattagcttggctttacctcagctggcccattcaagcagaaatgttccccaagcagcatttgaaggcgccccctctctgcacaggcagacctattttggtctgtgcactgcccctgtccacaggtttacacatccctggtctagctccatcagcctccaaacaggagacggggaagtcagttcaaccccctccacctccccacccacaccaatgcactcgttccaagcaagaggctccgagaaacatccaaggcaccttccactggctgtgaaacaccagaaggtccccacactcctactagattccaaagaaattcacacagagtccttccaaacctctgaaaataacctcagcggtgctgaaagaagcttccctagtggcagctgcctctctcggagaagctctgaaggaagctgtttccctccctgcaggggacagaagctggcggctgctaagtcccagctcggtcattcctacagcctcggggggccacgtcagttgtgaaaaacagcccagtctcaaattctggccccccctacggcttcgtgaattgaatgaagtaacaggaactatcacttattggacgcctgctgtatgccagaggccctgcatgatctcattccatctccactccagccctagcaaccaggttcaatcacttaaataggcaactgaggctcttaagatgaagtgacttatccaaggtcacacagtgagtacaaacccaggtgtgccgccagagcctgaactgggaacccctgcgcggtaactgcctcgtggcgaaatcggggtgtccttctgtttggccagtcgccgaagaggggtgttcctcttgggcggccctgagccaccctcggcgggtcccaggagcctgcgaggcagctcccgggagaatgggggtcctgaggataggctgggggtcccgggagcgccgaaacagcgggcccacctgtagtcctgcctgccgtgagggtaccccgctcccgggccagccgagccctgccgctgtctggcgccccctccgcctggggaagccccgaaggcagtttccgcccgcggccgcccgtcactcaccctgacactgccgccgaggacggcccggccgagggaagcaagcgagaggcgcggctgccgccggagccgggccccgtcgggctctagcctctccggccggctgcaggggtactgagaccagtacccgggggccagcagcgacccggaaacactcggcccggaaatgatgtcaccatgaggcgggcccgaagagagggtggaccacggctgcgcgctggctccgggaagcggtcgatgcccgcggccgacggagactacaacccagaggcggaggacaaagcggaaggccgaagagcgaggacgaaaccggcggaaccgcactttggagcctaacgagccatcgctgcgtctgagactgggacccggaagtaaacaggccggacgtgacgcaagccgctcggcctagggatggtggctggccgggttgtcatggaaaccgctcaggagcagggagctgggagctatgagtgctgactgcgtgaactcggcctccacttcccggacctgccacttatcatgatccacgagctgtactcatgactccgcacaagcaagcaggggctgacggtcggatccctcgcccccattttacggacagaagtaccgaggctcaaagagagccagtgagatgctgaaatcacgcgtgattggaatccagccttgctagggctgcgggtgttacgggccgtgggcggcggttaagagcgtgggttctatttttagttttgccacttactagctgtgtgaccttggacaagttacctaacctctctgagcctcagctttctaacctgtaatattaaataataaagccaggcgtggtggcacgcgactgtagtcccagctagtcgggaggctgaggcgagaggatggcttgctcccaggtgttcgagaccaacctgggcaacataacgaggccacgtctcttaaaaaaaaaaaaaaaaaaaaaaaaaaaaaaaagccgggcacggcggctcacgcctgtaatcccagcactttcggataaactatatatatatataatctgacatccccaccagaccctgagcttcttattcatctatttccccccgagctctgcacatgtctgatgaggaggcacacaacagatgttcattgattgtaggattctcactctgagtcttggtgaccccagctaaaaccggtggggcttgtgtgatgagtcagtgacacaatactgggaaacgtttggagaaccagcaatctgctgctgtccaaacagtagcattactgtgtttacctgtcgttgcctgagcaccgctcaaagtccctgtgttctttatcagctcatgtttaagctcctctcttaattatctgcaatgtgatgatgttcacaggaattccatctgagacaaactgtcccaccttaagtctgcctcttacagcaactcagcactctggtttggtagctcttacaatattgcattttcacgtggggctgcttaaaaaagtcccctccagctctgtgggtctatgacaggcaaaagagaaacaaagattttgaagaagggctttaccagtaggaaaccctggtcatcatctactatcagaaaagacccaaagtctccaaagacagtcacatttctcagttttttttttttttttttttttttttgagacggagtctcgctctgtcacccaggctggagtgcagtggcacaatctcagctcactgcaagctccgcctcctgggttcacgccattttcctgcctcagcctccggagtagctgggactaccggcacgcgccaacacgcctggctaattttttgtatttttagtagagatggggtttcaccaaggtggtcaggatggtctccatctcttgacctcgtgatccgcccacctcggcctcccaaagtgctgggattacaggcctgagccactgtgtccggccatgtttctcatcttttaaacacagttgaaggcttgtgatttctctacttggtgatgtagaaatgacaggagcgtcctttcccgactttattatataatgattaccagattatgtaagggtcacgtgacaatgattaggcacttctacttccgaagagccaacaacacgaacaatctacctacctctttctattttttagtttttttttccatcaccaaagtaatacatgattccaacaatacagaggagtatagaacaaaaagcaaaacagaaaagctaccccatgacccagcaattggatttctcaaaatctgctagagaaacatacactgtgcccaaagagacctcttgcatcattgtttctaatgcaaaagcaataataggaaatatttaaatctccatcactggggtaatggtatatccatactaacaaatactgtggatcacttaaaaagggtgatgcatggccaggcgcggtggctcacgcctgtaatcccagcactttgggaggccgaggtgggcaaatcacgaggtcaagaggccgagaccatcctggctaacacagtgaaaccctgtctctactaaaaatacaaaaattagccgggtgtggtagcaggcgcagtagcgggtgcctgtagtcccagctactcgggaggctgaggcaggagaatggcatgaacctgggaggcagaggttgcagtgaaccgagatggcaccactgcactccagcctgggctacagagtgagactctgtctcaaaaaaacaaaacaaaaaaagtcaactggggacaggaacacagatacagatatctgtctttcattccacaaacacacatttatgtgatctgtattaatatctttctcccccagaagtcagtgaactccatgaggacaaaactatgtctgttttgttcacaattatattactactacctgacatatatgcactacctagcatgcaataggttgttcaacataatttgtttctgaccagaattttcactgaatacctaccatgtgccaagtttgatgtcagattttttttttttaattgagacagggtctctcactctgtcaccctgtctggagtgtagtggcatgatcatagctcactgcagcctcaacctcctaggctcaagcgatcctcccaccttagcctcctgagtggcggggaccacagttgcacaccaccacatctggctaattttgttaactgttttgtagagggagggtctcgcaattttgccaaggctgctctcaaactcctgggctcaagtgatcctcccaccttggcttcccaaggtgctgggattacaggcatgagtcaccatgcccaccctgatgttaggtttaaagggcataactgtgagtgagacagacacagttcctgccctcacagagcatccagtctccttaaccgaaagagaatattcataacataggagtaggattaataaaaccctagaattcaggatagaagatggtaaatgatatgagaggggtatagagcttagagcatggagaagtgacctctgacagggtaaatgaaggatagcctccaggaggaagtagcatttgagctgggctttgagtgacctggacatgtgaggctgtccagctttccttccagctggagtaaagggagcaatcaaaggcaaggacctgagatcaaaaactcggctacctgtggctgggctcagtggcacaagcctgtaatcccagcaatttgggaggccgaggcaggcggatctcctgaggcccagagtttgagaccagcctgaccgatacagtgaaaccccatctgtactaaaaccacaaaaattagccagcctgtagtagtgcccacctgtggtcccagctactcaggaggctgaggctggagaatcgcttaaatctgggaggtggaggtggcagtgagccaagatcacgctactgcactctagcctgggacacagagggagaccctgtctcaaaaaagcaaaaacaaaaacaaaaaacaaaaacacaaactcagctacctgcaagcacataatgtgggcaaatacgaggtactagagtactatagcctcacactgcgtaggaccagaaatgagtaatgtaatctaacatggtacccggctcacagtaggcatccaataagtacttcagtgagaaaacaaatattgttgaattccttccatgcttcagctgacttgtggccaagatccccactcaccaggaatgaccagatactctgatttttggagaggagttagagatccagattgtttgtttatttatttatttaaagataaggtcttgatctgtcatccagactggagtacagtggcatgatcatggctcactgcaacctcaaacttctggactcaagggatcctcccaccccagcctcccacacagctgggactacaggctcatgccatcatgcccagttaattattttctgaagacgtgggatcttgctgtgttgcccagggtggtctcaaactcctagcctcaggtgatcctcccactttgacccaccaaagtgctgggattacaggcaccagccactgcgtccagcctggaatccagatttttaaataaaatttcttaattataaacaatatttgtaaatatacctcctgtttctacctgttgagagggcctagaagaaatggcacacctgtagcaacaagcacgtagactaagactaaccagatcttagtccatggaaccagggcttcctggagaaatggctgattcccaggggtaggtcagggaaattacaacatgaggttggaacatgttattgagccagaaagtaggaagtgcccaaagaatgatgggacatgttgaaagcacacaaaagccaggatggagggtccctattggccagatatgggcaatgtgagtatcaaaataaataataataacagattataaaacttaattgtggggagagaagttatgagcccatactaatgctaaacataaaatatcatgcttcatccaggcatggtggctcatgcctgtaatcccagcactttgggaggccgaggcaggtagatcatctgaggtcaggagcctggtcaacatggtgaaaccccatctctagaaaaatacaaaacaaaattagctgggcatgatggtgggtgcttgtaatcccagctacttgggaggctgaggcaggagaattacttgaacccagaaggtggaggttgcagggagctgagattgcaccattgcactccagcctgggtgacagagcgagactctgtctcaaaaaaaacaacaacaaccatgttttattttttattttttaggctagtcaagtgaagcaatgggaatggagaagaaacaaatctataactggttgtgatgaattagtcgtaagcaccactgcaattggaccagtcaataccatggttatcacaggagtgtggctgaggctgtgtttggccctgggtgccaggtctgcaccctgcactaaggatgggtgaggaacgacaggcagtcgagctggttggtgctacaggtaacgatagtacctaccaaaatacaggttaaatgagatagtccttgtgacatgataacatgttaattactcaattagcattagctatcatgaatcaatccttttatatgttttaaagcctagagaagcactttatccatagtggctgcttattacatttattacatttctcttgattgaatgaaatgatacagttttgctaactactagctcttacttcccatactgttttcttttcaggatcctcactctgatctaagagcataatttaattgtgttgtcagacagcttatcttcagggttatgacatggagtcagactgcctgggacatcatatttatttatttatttatttatttatttatttatttatttattgagacagggtctctgtcacccaggctagagtgcagtggtgccatcttggctcactgcaacctccacctcccaggcttaagcaatcctcctacctcagcctcccaagtaactgggactacaggcatgcgccaccatgcccttgtattttttgtggagacaggatttattcatgttgcccaggctggtctcaaactcctgagttcgccctctccctctccctccccctccccctccccctccccctccccctctccctctccccacggtctccctctctctctctttccacggtctccctctgatgccgagccgaagctggacggtactgctgccatctcggctcactgcaacctccctgcctgattctcctgcctcagcccgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgcagggattgcagacggagtctcgttcactcagtgctcaatggtgcccaggctggagtgcagtggcgtgatctcggctcgctacaacctccacctcccagcagcctgccttggcctcccaaagtgccgagattgcagcctctgcccggccgccaccccgtctgggaagtgaggagcatctccgcctggccgcccatcgtctgggatgtgaggagcccctctgcctggctgcccagtctggaaagtgaggagcgtctctgcccggccgccatcccatctaggaagtgaggagcgcctcttcccagccgccatcacatctgggaagtgaggagcgtctctgcccggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaagagcccctccgcccggcagccgccccgtctgagaagtgaggagcccctccgcccagcagccaccccgtctgggaagtgaggagcatctccgcccggcagccacctcgtccgggagggaggtgggggggtcagccccccgcccggccagccgcccggtccgggaggtgaggggcgcctctgcccggccgcccctactgggaagtgaggagcccctctgcccggccagccgccccgtccgggagggatgtgggggggtcagccccccgcccggccagccgccctgtccgggagggaggtggggggggtcagccccccgcctggccagctgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaattggatggttgctgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagagcggtgcaagatgtgctttgttaaacagatgcttgaaggcagcatgctccttaagagtcatcaccactccctaatctcaagtacccagggacacaaacactgcgcaaggccgcagggtcctctgcctaggaaaaccagagacctttgttcacttgtttatctgctgaccttccctccactattgtcctgtgaccctgccaaatccccctctgcgagaaacacccaagaatgatcaataaaaacaaacaaacaaacaaacaaacaaacaaactcctgagttcaagcaatccacccgccttggcctcccaaagtgctgggattacaggcgtgagccactgcgcccagcctcatcatctttctaagcctcagtttccccacctgtaaaatggagctgatcatagtatcttcttcataaggttattttgcatattgaatgggataacatgtgcaaagaagttcccccagtgcctggaaggcagtgatcctgcagcaaatgttatccacgattaggattcttgttgtcccacatgaatttgctgggtgctacagattctgtctggctcccaaagctcagaattcattctggcctcccacgggtggaggcagggtttgggggaggtttgtaactctaaagatggcacgtcttgaactgaaagctggcgctgtcaagcttcttcacaatcagtaagaacggctttcttcccccttttccctaaatataaacccaactgccaatcgctttaaagtcttcatgtctgcagcaggagcaacccacgagtccaaaggtgaggcagctggcagagggctgttgttagtgggatccacccagcccagcccagctccaaggagacacacttcatgggactggatgtgggcaactcagcatttcttccttatgattcttaattgctcctgaaaacagtaaccccaaagttacgagccccagtgtgtactataacagtctcttaaagtactgggtttcagggctgggcacagtggctcacttgtgtaatcccagcactttgggaggccaaggcaggaggatcacttgaggtcaggagttccagaccagcctggccaacatagtgaaacaccatctctagtaaaaatactaaaattagccgggcatggtggcgcatgcctgtaatcccagctacttgggaggctgaggcaggagaattgcttgaaccaggaggcggaggttgtagtgagccgagattgcaccactgcactccagcctgggcaacagagcgagactccatcgcaaaaaaaaaaaaaaaaaaaaaaaagtattgggttttagaagacggcttgctggaagcaaacatctttgtccttccctctcccttgaagcaagcaaaggaaagccacacacaggttgtccttattacatagcaacattatccctaggccagaagtcgaagtaggctctggagccgaaaggcttaagttcagatcctagccctgccgctttccatctgtgtgaccttggacaagctatctaacctctctgggactgcctctatttccttatcagtaaaatgggattaatagtacccctgaggattattgagagattaaatgagctaataatatacgatgccaagtgcagagtgagcattcaacacaagctagatatgactgactcagtcacagggcttgccaggctggggtgtagagtcagcctcagaccaatggggaacataatgggacttatgccattatggtcaggccttgacaccttgcatttatgctgctcaaaagaggaggattttggctaggggccatggctcacgcatgtaatcccaatgctttgagagggcgaaactggaggattgcttgaggccagaagttggagaccagtctaggctacatagtaaagccccatctctccaaaaaattttaaaaattaggtagacacgtagcatgagcccatagtcctagctactggggaggctgaggtgggagaatctcttgagcccaagagtttgaggttacagtgaactgtgatggcaccactgcactccagcctcagcaacagagtgagaccctgtctctaaaaaaaaaaataagttaaaaaaagtgtagaattgtataatatccagaatatatgaagaatttctataacgcaacaacaaatagacaacccaatttaaaaatgggcaaaggtggctgggcatggtggctcacacctgtaatcccagcactttcggaagccaaggggggtagatcatttgagctcaagagttcaagaccagcctggccatcatggcaaaatcccatctctactaaaaatgcaaaagttggccgggcacagtggctcacacctgtaatcccagcactttgggaggccgaggcgggaggatcacctgaggtcgggagttcaagaccagcctggccaacatggtgaaactccatctctactaaaaatacaccaggagcagtggatcatgcctgtaatcccagcactttgggaagccaaggtgtgtggatcacctgagtttgggagttcgagaccagtctggccaacatagtgaaaccccatctctactaaaaatacaaaaattagccaggcatggtggcatgtgcctgtaatcccagctacttgggaggctgaggcaggagaatcgcttgaacccaggaggcggaggctgcagtgagtcgagattttgccattgcactccagcctgggtgacaacagtgaaactctgtctcaaaaaaaaataataaaaaaatttttttaaaaatacaaaaattagctgggtgtagtggcaggcccctgtaatcccagctacttgggaggctgaggtgagagaatcatgtgaacctaggaggtggaggttgcagtgagccaagatctcaccattgcactccagtctgggcaacagagtgagattctatctcaaaataaataaataaataaaattaaaaatgggcaaaggacttgaatagacatttctccaaagaagatacacagatggccaataagcatgtgaaaagatgtgtgtcatcactaatctttagggaaatgtaaatcaaaaccacagtgagattccacttcaaaccctctagggtggctataataaaatgtttttgaaaaggaaaataacaaatgttggcaatgatgtaaagaatggaatactcgtacttgctggtgggaatgtaaaatggtgcagccactgtaaagaacagtctggcagttcctcaaaaagttaaatacagaatgaccatatgactcagcaattctgctcctaggcatatgcctgaaagaattgaaaataaggactcaaaacagacacttgtacatcaatgttcattgcagtattattcacattagccaaaaggtagaaacgacccaagtgtttgctgacagatgaatgaataaacaaaatgtggtacatccatgcaatggaatattattcagccttaaaaagtgaggaaattccaatgctacatcatggataaaccttaaaaatattatgttaagtgaaagaagccagtcacaaaaggacaaatattgtgtgattccactagatgagatgtctgtaataggcaaattcatagagacagaaaaaggattagaggttaccagtggctggagagggaggaatggggagctatttcttatagatggagtttctgtttaggttgctgaaaaaattttggaaacagaggcgatgtttgcacaacattgtgaatgtaattactgccactaaagtatatgctttatggtggttaaaatggcaatttttatgttatgtatgttatcacaataaaaaaattttggggggggccaggccagtggctcacacctgtaatcccagcactttgggaggctgaggtgggtggatcacttgaggtcaggagttcgagaccagcctggccaacatggtgaaaccctgtctctactaaaaatacaaaaaaaaaaatagctggatctcatgacacccacctgaaatctcaggtactcgggaggctgaggcaggagaattgcttgaacccaggaggtggaggttgcagtgagccacgatcacaccattggaatccgtgcactccagactgggcaacagagcaagaccctgtctcaaaaaaaaaaaatggtgtggctgggcacagtggctcatgcctgtaattccagcactttgggaagccaatctgggtggatcatttgatgtaaggagttcgagaccagcctggccaacatggtgaaaccctgtctctactaaaaatacaaaaaaattagctggacgtggtggcacacacttgaaatcccagctactagggaggctgagggagaagaattacttgaaccgggaggcaaaggttgcagtgagccgagatggtaccactgcactccagcctgggaacaaagtgagactccatctcaaaaaaaaaaataaataaataaataacagaagatctggacagacacttcacagaggtaaaacatacaaaatggccaataaacaaatgaaaaggtactcaacgtcattaatcattatgaaatctaaaattgcacagtaccactacacactcactagaatggctaaaagtgtctgacaaccaaatgttggtgaggacgtgaagcaactcataccttgttagtggtcatgggaaatagttggaaaatggcttggtttggcagtttctaataaaattaaacacacattggccgggcacggtggctcacgcctgtaatcccagcactttggaaggccaaggcgggcagatcacctgagatcaggagttcaagaccagcctggccaacatggtgaaaccccatctctacaaaaatacaaaaattagccgggcatgatggcaggtgtttgtaatcccagctactcaggaggctggggtggaagaatcgcttgaacccaggaggcggaagttgcagtgagccgagatcgtgccattgcattccagcctgggcaacagcaagactccatctcaaaaacaaacaaacaaaacagacaaacaaacaaacaaaacaaaaaaaattaaacacacatttacgaaatgacccggaaattctacttctatgtgaatgcttagttttgaaatgtcttgttaattgtgatgactttcttctatccttagccaatgtctcaagtcacaatatacacatgaggtgcagtttattgtagatgaaggtggattcaaatcccctatttcaatgtcttcttgttagtactcattatttggttgtagttcttgtcagatattatgagatcgttatgtttttacctcattatgtggctgacccttgatataatagaaactgtaaaatgctatgagctggtgggataactgatgaaatgcaattttctggaggcagtttttttttaatttttttttttgagacaggctctcactctgtcgcccaggctggagtgcagtggcgcagtcttggctcactgcaacctctgcctcctgggttcaagcgattctcctgccttagcctccttagtagctgggattaacaggcatgcgccaccacacccggctaatttttgtatttttttggtagagactggggttttaccatgttggccaggctggtctcaaactcctgacctcaagtgatacaccggcctctgcctcccaaagtgttgggattacaggcgtgagccgctgcaccctgccaggggccgcatttttatgtgatcatccccgcgtggctttcctgtttgagactgaataattcactgttacatttccaacacttaccaggatacttagcacatagagttattggttgaatgaatatttacatgccagtgtctcctctgttaagactccttttaggctgagactctttttttttttttttaatttttgttttcaggcaatgtacagtaagccatgatgggcagaggcaggaaatacttagagaactggaaagaataaaggagccggtgttctcttcgcagggcccggtgagtctgtgagatgctcacacgccccctggtggtgtcagtaggaattcttcctggcgctcagcaatttggcaatcttgaagaaccggctgaaatcaagatgaaattatctgcccacaggtttaaaaatgtagcaatacatgatggggtaaattatgcctaacttagacaagtatagcgataaattttacatgtggcctgaggctgatagaactgtgacgcctgagagttacaggatttgagggctggagttacttccgattcatcttaactgttcttaatgcatcattgtttattttttctttttttaagagaaaaaaaagtcacccaggctggagtgcaatagcacgatcatggttcattgcagcctcaacgtcctggggtcaagcagtcctcctcagcctccccaagtgctgagcccacatgtgcatgcccctatgcccagatattttttgtattttttgtagggatgggatcttgctatgttgcccagggtggtctcgaactcctgggctccaggcaattgccttagcctctcaaagtgctgggattacagatgtgagccacctcacctggtcccgaatttttaattaaaaagtggtgcatgaacttgatataaatatttagacaacacaagaggaaacagaaggagaagtctttctccaggcccagaacctaagacccagtcccttagctccccttttgttttttggttttttgtttgtttgtttcttttcatataaaatagagacagggtcttgccatgtttcccaggctggtctcaaaccgccaggctcaagtgatccacctgccttagcctcccaaagtgctgggattacaggcatgacccaccacacccgggccattttccctttctaataggaaccattggtaccagattctcagaaatcttcccaggaggccgggcgcggtggctcacgcctgtaatcccagaactttgggaggccgaggcgggtggatcacctgaggtcaggagttcgagaccagcctggccaacatggcgaaatcccgtctctactaaaaatataaaaaaattagccgggcgtggtagtggacacctgtaatcccagctactcaggaagctgaggcaggagaattgcttgaacccaggagatggaggttgcagtgagccaacatggtcccactgcactccagcctgggtgagagtgagactccgtctcagaaaaaaaaaaaaaaaaatctttccagtagggcaattgactcatcctgttttgcccgggactttcccagttttggcactgaaagtctcacatcctgggaaacccctcactcccaggcaaacctggacacttggtcaccctactttccaaaggcatctatttatcatatacaaacatatacatatattagttgcattacttggcatcttgatgttgttttaattaaaaatattttttgggccaggtgcagtggctcacacctgtaatcccagcactttgggaggccaaggtgggcagctcacttgaggtcaggagttcaagaccagcctggccaacatggtgaaaccccgtctctactaaaaatacaaaagttagccaggtgcagtggcgcatgcctgtaattccagctactcgagaggctgaggtaggagaatctcttgaacccaggaggcagaggttgcagcgagctgagatcgtgccactgcactccagtctgggtgacagagcgagactccattttaaaaaaaagttttatatatatatatatatatgagatgattcaatatcagcttcatatttatttaacaaatatttatgtaattacctagcatgcaccaggcattattttggaagctgaagataacagcagtaaacaaaattgacaaaacctcctgacctcatggaattgatatactagtaattatatctattgcatttgtttaatcacccccaatcatcattttggttgcttccagtatcttcctagtgtgacaacgctgtcctggatatccgtgtgcatgtagctgtctcacatgcatgagggtatctatagcagcgctgtccaatagatcttcctgcaacgatggaaatgttctgtgtctgatcttttcaatatgtagccacgagtcacttgtggctattgagcactagacatatggctagtaagactggggaatagaattttatattttatttagttgttttgttttgttttgagacaaagtcttgctctgtcgcgcaggctggagtgcagtggtgcagtctcagctcactgcaagctccgcctcctggcttcacgccattctcctgcctcagcctcccgagtagctgggtctacaggcacccgccaccaggcccggctaatttttttgtattttttagtagagacagggtttcactgtgttagccaggatagtctcgatctcctgccctcatgatccatccacctcggccttccaaagtgctggggttacaggtgtgagccactgcgcctggccttttttttttttttttttttttttgagaaagggtctctgtcagtcaggctggaatgcagtggcacaatcatgtttcactgcagcctcgatctctagagcttaagcaatcctcccacttcagcctcctgagtagctgggaccacaagtgtgcaccaccacacgtagctagttttttttatgtagagatggcggggtcttgctatgttgattaagctggtttcaaactcctggcctcaagcgatcctcccatgttgacctcccaaagtgctgggattacaggtgtgagccactgcacctggcattaattttgtttttttttttttttttgagacagggtcttgctcttgcccagactggagtgcagtggcaagattacagctcaatgatgctttgaactcctgggctcaagcaaccctcctctgagtagctaagactacaggcacatgccactgcactcagctaattttatgtttgtttgtttgtagacagcagggtcttggtacgttgcccaggttgatcttgaactcctggcctcaagtgatcctcccacttatttttgtattttttgtagagatgggggagggagttgggggtggtggggtgtctcactgtgttacccaggatggtcttaaacccctggacaaaagtgatccacccccctcagcaacccaaagtgctgggattacaggcgtgagccaccatgcccagccctttcttaaatttaagcaaacaaattttaataatgatggctgactcctgtaatcccagcactttgggagaccaagacaggaggaccatttgagctcaagagttcgagaccagccttggcaacatggtgaaaccctgtctctacaaaaaatttaaaaattagctgggtgtggtgtgcacgcctatagtcccagctacttgggaggctggggtgggaggacggcttttgcccatgaggtggaggttgcagtgagccaagattttgccattgtcctccagcttgggcaacagagccagaccctgtctcaaaaaagaaaaaaaaaagcctaggcaacatagtgagaccccatcactacaaaaaatagaaaaaatagctaggtgtgatggcacatgcctgtagtctcacctactcaggaggctgaggcaggaggatcacttgagcctgggaagtcaaggctgcagtgagctgtgatcacatcactgcactccatcctgggtgacagagtgagactctgtctcaaaaaaaaaaaaaaaaaaaaaaaggaaagaaagaaagggagggaaggagggaaggaacaaaggaaggaacgaaggaaggaaggaagggaaggagggaggaaggaaggaaggaaggaaaaaaggaaggaaaaatttaggctgggcacaatggctcacgcctgtaatccctagcactttggaggccgaggtgggccgatcgtgaggtcaggagatcgagaccatcctggctaacatggtgaaaccccgtctctactaaaaatacaaaaaaaattagccgggcgtggtggtgggcgcctgtagtcccagctactcaggaggttgaggcaggagaatggcgtgaacccaggaggcggagcttgcagtgagccgagattgtgctactgcactccagcctgggcaacagagcgagactctgtctcaaaaaaaaaaaaaattaatttaaaagaaattttttttgagactgagtttcactcttgttgcccaggctggagtccagtggctcgttctccactcactgcaacctctgcctcctaggttcaagcgattctcctgcctcagcctcccaagtagctgggactacaggcatgcaccaccaggcccggttaatttttgtatttttagtagaaacagggtttcaccatgttggtcaggctggtcttgaactcctaacctcaggtgatccacccgcctcagcctcctcctgctgagattacaggcatgagccgccatacccagctttttttttttttttttttaaagaacatgattcaactgtattgctctctataagaaactcactttatagactggttctgaaaggatggaaaaagatatttcatgcaaatatctttttgcgtgaccaaagaagaggagggctggcaatactaatatcagaaaaattacttgtccaggccgggcacggtagctcacacctgtaatcctagcactttgggaggccgaggcgggtgcatcacctgaggtcaggagtttgagaccagcctaaaaaatatggtgaaatcctgtctctactaaaaatacaaaaattagccaggcgtggtcgtgcatgcctgtagtctcagctactcaggaggctgaaacaggagaatcacctgaacccaggagacagaggttgccgtgagctgagatcacaccactgcactccagcctggacgacagagcaagaccctgtctcaaaaaaagaaaaaagaaaaattacttgtccaaaaggttacaagagataaagaaggcattgtatgttaataaaaagttcaatacagcaagaagatataacaattataaacatttatatacctaataacagaccatcagaacatatgaagcaaaaattggtagaattgaaggaagaaatagacaattccacaataatagttagagacttcaatgccccactcccaagaataaatagaacaaacaggagacaagtaaggaaataaaggacttgagcgacacagtaagacaaccaggtctaacacatgtacagacactccccagcaacaacagcatccacattcttctcaggcacacatgggatatcctccaggatggaccatatgttaggccacagattaagcctcaagagattttaaaaggtagacatcagccagctgtggtggcttaggcctgtaatcccagcactttgggaggctgaggcaggaggattgctcgtgcccaggagtttgcaaccagcctgggcaacacagccagacttcatctctacaaaaagagacagaagaaaaggagaaagagagaaagataagaaggaaagaaagaagaaataaaagagatcataccaaatatcttctccaagcacaattggataaggctagaaatcaatatgggggggttaaaaaaaaaaagaaatcaatatcaaaggaaaactggaaaattcacaaatttgtggaaatttacacactcttaaaagaaccaatggatcaaagaagaaatcacaagggaaattagaaaatactcagaaacaggccaggctgggtggctcacacctgtaatcccagcattttgggaggccgaggttggcggatcacttgaggtcaggcgtttgagaccagcctggccaacattgtgaaaccctgtctctactaaaaatacaaaaattagccaggcgtggtggcaggcacctgtaatcccagctacttgggaggctgaggcaagggaattgcttgaatccaggagagggaggctgcagcgagcagagattgcaccaatgcactccagcctgggcgacagagtgagactccatctcaaaataaataaattaattaaataaatagagaaaatattgagaaacaaatgaaaacaaaaacacagcatgccaaaatttactggacacagtgaaagcagtgctcaggggaaattttatagctataagtgcttcaaaatcatagacagaaaattgccagggcctgggggtatggggatgggaggagggaagaggaagttattgtttaatggggacagaatttcagtttcagtttagcaagaagaccagaattttagagatagctgatggtgatgattgcacaatatgaaatgaatgtactttgttgttggggtttttttgttttgttttgttgttgttgttgttgttttttgagagggagtctcgcgctgtcgcccagactggagtgcagtggcaagatcttggctcactgcaagctccgcctcccaggttcaagccattctcctgcctcagcctcccgagtagctgggactacaggcgcccgccaccacgcccggctaattttttgtatttttagtagagacagggtttcaccgtgttagccaggttgtgtttttgtttttttttttttttttcagacggagtttcgttcttgttgcccaggctggagtttagtgactgttggagtgagtgagccatcttggcccacggcaaccttcgcctcccaggtcaaaggcttttcctgcctcagcgtcctgagtagctgaggctacaggcatgggcaaccacgcctggctaattttagtattgttagtagagacggggtttcaccatgttggccaggctgctctagtactcctaggctcaagcgatccgcccacctcggcctcccaaagtgctgagattacagaagtaagccaccttgcccagctcctttgtataaataaatgatattgattttcttcttgcagctcaggaattagatctgttattagaatttgcttaaatttaagaaatggctgggtactgtggctcaccgctgtaatcccagcacttcgggttgccgaggcaggcggattgcttgcgtccaagagttcgaggccagcctcggcaacacagtgagacccgcccgctctctgcaccactccttccccccctcctttccccgtctctacaaaaaatacaaaaataaataaattagtccggcatggtggtgactgcctgtggtccagctacgcaggaggctgaggtgggaggatcgcttgaaccccggtggtcgaggctgcagggagccatgatcgcgcgcgccactgaacaccagcctgggcgacaaagcaagaccttgtcccaaaatagattaaataaataaataaataaatttaaggaaaaagcaacttgattcgaagataaatagtgatagtgcaagtggtgccgaactaacgataaatttggaaaacagcggcccacgcgcagagcccgtcccaattctggcagcctttggatttggcttccacgttttccagatttccctcggcctctagctcgcttgcgtcagaggggccccgaggggcggcccacccgctagccccgcccccaaccgctcaccgccccgcgagccccgccccctcggcctcctcctcatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtgtaagcggcgagcccgggcctggtcggggggcgcttaactgggaagggaatggagccgaggagcgagatgggtctcagggcgggagccagaggacccacccagaggggcctcccgggggtgtcccccggggctcctaagggccgtgaaagctgccggggcgctcttctgtcccgccccgctcactcctaagtatcccgttcctccgcccgtcttagcggggcagctgctgtctgttgagcgcctgcgatgttccaggcggcctgtcagtctccttcccacacgtgatagtggactcgtgccctgcggggactttaggctccgaagtccgcccttggagagccgacgtttcctttctagtccacgtcgctcttaaagcataggacatttggcgtcgtgtctagctgtggcgagttattctactgtgcactaaagtcgggagaaacgctgaactagactaaaacaacaaaagggaagtctttatggggatctggccagtttgcccttagctgtgaaaggggggtgggagttggcagatgggattgttagcattctacttcctgtgtaggaggtttgtttctttcagttttcaattaagccttcatgacctgaatattgtgaatagagtggttataatgattaaagcagatatgtgtataaatgtccagtccaggtcctgggctgtggccggggctttcgaggttggtcaggttggtcgatttgaatctaagccttgttccatcagacgcacaaacacatctgagttgaaagaattgtagacaacgtggccacctgcttcttgcctcagaattggcttttcctctggcccctctcagtgcttatcgtgggatcaccttggcattggtcttggcagcgggcacagtagccattgcactccatgggcattattctatagccaccctgcagcgggggagggttggcagccattttacaggtgaatacactgagggtccgaggctctcttagggaagggtcaccgtggcctagctcttcccagatgtactgcaggtgaccatttcagtagtccagagaacagtgcttggcacctagctggctgctttttgcttcatcatgttgctttaggctattcatctttgcaattcggttagcctggaactcttccccccacccctcccttttcaggcttcaagtcccaggttaagttacctcaccaaataccatccccatctaaattacttcccccacttcctttctgggacttaacttccttctccttgcttgcacagagcaaaacttaacagctcatgacggagtggccatatctttattgcccctgaactgactggaatggcctctgtgtgccagattttggggtagactctgccttcagagtttacagtccagtgaattgattataaataagtaccaatgactggtcaaactattgtaaaaattcattctgcaagtgggagggtatttcagggatcacacctctgtgcgtggggtgagtgatcaggtaatggttgaatgaactaataagtcgtgtaagcaagcttcacgagagttgaagtggtctttagctttttcattgaatccacttatccttggatcagatttacctgattttggattaattcagtggatttcatttactattaacatttgtaaaaaggctagacccagcacagtttgctaaatgaagagcagcaaaatttgagattttcttgagcttggtgaacctttcctaggtcagagggcaaggaacagtactggttttcaaaccttggctcttctctatcctcgctgtcctagccccacgtgatcagcagttcagtgcaaattgaagacagatggaagcacctctgtgagggcagcccaaatccccgctagctccaaccgactgctttctcctgtgcctagttgatttttaccttttgtgcttggaaagttgagcatcactgcaactctggctggggcattggatttttataaaactttatttcaagccctgaatgactgtgttctccaatctggtagaatacagctggagaaaggcagctggctgggtgcccaagagaagggaatttcttcctagcactgtgacggagtggagcatcggaaggctgaactagaaaagggcgcataagtaggaaatagaaactgaaaagccatcccaggatatttgagttgttcaaaagcaggctggtagtttgggcatgtctcaggcacaaagtgactcgtgaacatttgatagatgagctgtacctgtgtgtgtgcttgagaagagacttcgagctgcttttatctgcatgctgggtttggttccattatactcactggaccctctgtgctctcttgggttcctcttgtcatctgcctttgtgaacaggcaacacaagtgatggccacaggccctgcctgtctctactgcctcatcacttgcccttctcaccatggtctaccgcatcatggcccccaaggtctgcctgccttcctttccagtcctcatttgtgtgtggcgtgatcttggtgtggagctctgcacccagatctgtgtggctgtcctcgtaatcaggtcccacccagctcaaatgccaactcctcagaagcagctttctatgatcaccccagctggtctgtttgccatatttccttcatatttttaatcactatctgaaattaacatttgtgtttcccttcactctagaatgtaagcatcatgagaacagggctttgtcaagtttccattgccctcagtggtgaatgaatagactccctcaccttctctgtacctggtctggaattttgcctaacagcattaacatctaacttaatgacaaggaggaaggagattcttagaggcagtagaaaatggtcaagtgttcagaagatggcctttcattatatatctttagttctttctggcagatttggttatactgtcttaatctatcaggttgggtaagtagcccagggtgtcttctccattctttctgtatgccttatctcagcattaccatcttcctaggcttcaggataggaactcggtcatctttgacttcttttcttcaaagtcagtaagttatcaagtcctcctgattctacctttctgtgaatggtttcctgaattcatcccctgctgcttcagtcagaccctcacaatcctctgcctttagccatctgtttggtttctactttgtctcttctcaccttctcacctaaaaaaaaaaaaaactatagggctgggctcagtggctcacacctgtaatcccagcactttgggaggccaagacgggtggatcaccagaggtcaggagttcgagaccagcctggctaacgtggtgaaaccccgtctctactaaaaatataaaattagctgggtgtggtcatgcgcgcctgtaaccccagccacttgggagtctgaagcaggagaatcgcttggaccggggaggcagattttgcagtgagccgagattgcaccattgcacttcagcctgggcaacagagcacgactctgtctcaaaaaaaaaaaaaaaaaaaaaagtaacaaaactttgttttccatgatagcacagagatatttttctgaaacctggatttggccttgttttgttaataccttccttttaaactcctggctccctactgtttatgaggaaaagtctgttagatttttatttcctcagatacatatcaattttaagcctaaattaggcctagaatagtcttcccttcctctgctagctgacctctttttttaaaatgccagaggggtaatgggccaacatctgtaacaaggttcgagggtggcacatctcacacatgcacatgaacacccagtcctcaggttcatgaactacaaaaggatccatctgaacccttttttttttttttttgagacggagtctcgctctgtctcccaggctggatggagtgcagtggcgcgatcttggctcactgcaagctctgcgtcctgggttcatgccattctcctgcctaagcctcccgagtagctgggactacaggcacccgccaccactcccagctaatttttgtatttttagtagagacggggtttcactgtgttagccaggatggtctcgatctcctgaccttgtgatctgcccgcctcggcctcccaaagtgctgggattacaggcatgagccaccgcgcctggctgagctgaacccttttaaggctgatcagagatgccgtctctgcagtcttcccctccaccccccccttgagacagagtcgcactctgttgcccaggctggagtgtgcagccacctctgcctcccaggttcaagcaattctcctgcctcagcctcccgagtagctgggattacaggcatctgccaccatgcctggctaattttggtatttttagtagagacgggtttcaccatgttggtaaggctggtctcaaactcctgacctcgtgatctgcctgccttggcctcccaaagtgctgggattacgggcgtgagccaccgctcccagccttcactgcagtcttaccagccctttccttctcaggtcactagttgattttccctttatgttcctgtagcgctttgccttcacctgtaatgatagcagctcccgtttgtggtgcgttttgtaagggctggacactctgccaggggtctgctatacaaactgtatcctcccagcagtcctagaggtaggtactactctctccatttcacaaaggaaaaaatggagattcaagaaaccccactgagatccttcagtggcagggcctaaggcttgaagcctcaaccttaacaccttcactgtgtctatcacaggagtttgcatttgtttctgtagttgtgtgttctttgtagtccactcctatccctcattttttctggcttggaaggacttagtatttgaactgggaggagagagcaagttgttttttactccattatccattgatgtctttttaaaagttgatccatatttgtcgtcttgtctccatgatgcgtgacagaggttctctgtatgtcttgttctagcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatgtatgtggaagtgatgtggaagagtccatgtctttccatgataagttggggtaaaacgtacagctgccatgttgttgctgaagttagagcatgactaggtcactaacagcacgcgtgcatgccaattacctgtggtgatggctgggctggtttgttttcataaccttactggtttttgtttctttttttaagagttggttaagtatatattttaggtttgaaagccatagaaatcagttatcccagttttttcctataaaagatcaattatggccaggcgcggtggctcattcctgtaaccccagctctttgggagtccgaggcaagagcttgaggctaggagttaagagaccagcctggacaacatagtgagacctcatctttacaaaaaaataaaattagccgggtgtggtggtatgtacctgtaggcccagctactcaggaggcagaggccagaggatcacttgagcccaggagtttgggattacagtgatctatgatcatgccactgcactccagcctggctgacagcaagaccctgtctcttaaaaaaaagtcaatatgaaatcattggattgtaataacaatagctaacatttgaaatgcatccatgctcttgtataatcagagtcaagtatatttattttcatacctgttataactgctactggaaaggagaaatactgttgtcttattttccaagagatatacacagccttgttgattttagaatcattaaaatttttaaaattgcagaccatacaaaagtacacaataatgtaggcttgttcctcattccagagattacttcaaaattcgttcaacttaaggcctggcaaggtggttcatgcctgtaatcccaacactttgggaggccaaggtgggtggattgcttgagtccaggagttctagaccagcctggacaacatggtgaaacctcggctctactgaaaatacaaaaaactagcagggcatggtggtgtgtgcccgtagtctcaactgttcgggaggctgaggtgagaggatggcttgagcccaggaggcagaggttgcagtgagctgagttcgtgccactgcactccatcctgggtgatagagccggaccctgtctcaaggaaaaaaaaagtgatttaatttcgaaagctgcataacattttctgccctttgacaaacactgtagaatttttaccaaccaagttgtaggatttttgcaaaatgagattatactataatatatatatttcttcaacttttttcacttttttaaatgtacactcattcccaactttttttttccacttttcaggttttttttctcttacatattggacagccttgcatgtcagtttcattatttttaacacttcggtatggatgcccatagtaagaatataccttaccatctccttttcagcgtgatttagtattagggatgcatagtagggccatttcaatgctgaatagggctattttctgtgtcttaattgggggcttcactcttgaggctgggcatggtggctcatgcctatatcctatcatttggagaggccaaggcaagaggatcactgaccccaggagttcgaaatcagcctgggcaacatagtgggactctgtatataccaaaacaaaccaacaaacaaaaccagctgtgtgtagtggtgtatgcatgtagtcccagctccttgggaggctgaggtgggaagattgcttgagcccagaagtttgagagcagcctggggaatatagtggacccagtttctacaaaaaaaggaaaaaaaaattgaggattcctcagtttgtagcttaaagtcaagttcttgagctggaggtgagacaatcatcatggtaagctggagctcaaatattggagcatttttttccccctttgaagtttacttttagaaactcaaaatattgaaatacaattccctactgtcttctttttttttttttttttttttttttgagacggagtctcactctgttgcccaggctggagtacagtggcgtgatctcagctcactgcaggctccgcctgttgggttcacgccattctcctgcctcagcctcctgagtagctgggactacaggtgcccatcaccacgcccagctatatatatatacacacacacacacacacacacacatacatacacacagagatatatatatatatatatatatatatttgtatttttagtagagacagggtttcactgtgttagccaggatggtctcgatctcctgacctcgtgacccgcccgcctcagcctcccaaaatgctgggattataggcatgagccattgcacccggtctcttcatctttatttatgcatgcataatgtggtttttggttttgttttgttttttttctgagacagggtctggctttgttgcccgggctggagtgcaattgcgtggtctcagctcactgaaacctctgcctcccaggctcaaaccatcctcccacctcagcctctcaagtagctgggactacaggcatgtgtcaccacgcctgcctaatttttttgtattttcagtagagacgagttttgcatgttgcccatgctgatctcgaactcgggagcgtgaagtgatggcccacctcagcctccctcaggattacaggtgtgagccaccgtactccgcccatgatgggctttttgtttgttttactgtatgcttttgcttttctccattttcaagattagtgattgtactgttggcatgcctcagaaaatgtttttctttcctttatcttccctcttttcttcaattcttaaaactttctttctttttagaaaacctgtaatgaagcactattctctgggttttcttctctttctgttttactgttgcacagcctagattttatatgaaaggctgggccgggcgtggtagctcacgcctgtaaacccagcactttggcaggctgaggcaggcagatcacttgaggtcaggagttcgagaccagcctggctaacgtggtgaaactccatctctactaaaaatatgaaaattagctgggcctgatggcacacacctgtaatcccagctactcaggaggctgaggtgggagaatcacttgaacccgggaggcggaggttgcagtgagccgagatggtgccactgcacttcagtctgggcgacagagtgagtgagactctgtctcaaaaaaaaaaaaaaagagaatttagattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggtaaatgactcagtctccccttaggtggaggtcatctcttgctattaatacaaagaggttgcatgcccaggggtttagttgtatgaattgttatgctggctaaagctgatacaagtattttgggaggagtatgcaagggaggactctggtgttcacttcagatgttagctgagctatattctttttttcttttttgagacagagtctcgctctgttgcccaggctggtgtgcagtggtgcaatctcagctcactgcaacctctgcctcccgggttcaagcgattctcctgcctcaacctcccaagtagctgggattacaggcacctgccaccatgcctggctaaattttgtattttttagtagagacagggtttgtcatgttggtcaggctggtcttgaactcctgatctcaggtgatccgcctgctttggcctcccaaagtgctgcgattacaggcgtaaaccaccacgcccggccagctgagctgttattttcacaacacttgacctgagtctgaagtgatcatcagcatccttatcattacacatttggtgagctttgctcctttttggagtgtactgtggttgaagtttaatggaaaggtactcacagaaaagttttcttttttcctgtgtttcaccttccaggaatgttccaaaccgttacacctttccttgtccttactgtcctgagaagaactttgatcaggaaggacttgtggaacactgcaaattattccatagcacggataccaaatctgtggtgagtaacctttttttttttttttaaacttcattaagggaaaggatcaagcttggagaaaaatgacgggattagtagaatgaactcctgtgtgcccttcacctagattgacagattgttaacattttaccatatttgcttaaccatgctctatagtacacattttttgctgaccacttgggaataagctacagataccatgaccatttttgcaccctgaatacttcgcaccctgatacaggagtgtgtatgtcttaagaacaagaatgttttcttggaaaattatatttttgtgtgtataattaatcatattcaagaaatttaacattgattcaatctaatgtctaatgtgaaattcatgttttaattttaacaattgtaatgtctttcatagcaatttccccctccccccaaggcagaggcagggatggtacacgagttctctgtcctctgggtgctacattaagtcatgtgatgtctgttgttggtaacattaacttggttcccttggtgtccaccaaatttctccatgaagctgccattttatttttggaagtagcttcttcatagttgtggggaaagaggatttaggtgaaattattaggaaaaggcttatcaatccttggacattttactcagatattacctactggcatgtgtagtctcctttaaaaaaaaaaaaatgtaggctgggcacggtggctcacacctgtaatcccagcactttgggaggccaaggcgggtggatcagttgaggtcaggagttcaagatcagcctggctaacatggtgaaaccccatctctactaaaaatacaaaaattagccaggcatggtggcgggcgcctttaatcccagctacttgggaggctgaggcatgagaattgcttgaacctgggaggcagaagttgcagtgaactgagatcctgccactgcactctagtctgggcagcagaacaaaactgcccccccccccccccccccccccaaaaaagtatttgttccatcttagcaatgtgttacctttctctctcaatgtgattgacagaccaggtctttttttatagttaggtgtatacttcctctatagttttaatttttccatttatctcatactgcttctcttgaactacatactctgttgtatgggcagccttcagctccattgctgtaaacagtggtgcagaaattttagaattttaatgagcttttgtgagagtactagggcagctatcaatgctcatcttaagatggaactggccattttgagaaacatatctttgcctgtatctatgtatgtttataagctaaagtcttagatacagattgacttggttaaatgttacttgcactcataattttgttggatactgttattgctgaacttttctggtatggcagcctaattttctgtctttttcccctcctttggcttctgaaatccctctgattatgttgtctatgttgaggccttctcttcagcctttggccctctgttctgtcttcctctccctctgcaagttttttttttttttttttttttttttttttttttttttttgaggcggagtttcgctctgtcgcccaggctggagtgcagtggcgcgatctcgactcactgcaagctccgcctcccgggttcacgccattctcctgcctcagcctcccgtgtagctgggactacaggtgcgcgccaccatgcccggctaatttttgtatttatggtagagacggggtttcaccgtgttagccaggatggtctcgatctcctgacctcgtgatccgcccgtctcggcctcccaaagtgctgggattacaggcgtgagccaccgcgcccggccctctgcaagttcttaactctgcgtttctcccttccctttagaagccatctccttttcagtctctagtcccaccctatgttctagctccccagctacagctgcctgcccaccttttccactcagtcttctaccattccagatttctctcttgtcaatcccctttatcactgtatcttccttgctgtggggtagggttccacctttaagtgggggcacttaggtcttctctctccctggcatgagttttctgcactcactggtctggttgtttacatgtgttgacagtaactgccgccttctggccttttctccgtgctgctgcctctcttctggagcacaatttttttttttttttttttaagacagagtctcactctgtcacccaggctggaggctggagtgcagtggcacaatcttggctcactgcaacctccacttccagggttcaagcgattctcatgcctcagcctctcaggtagctgggactacaggcgtgtgccaccatgcaaggctaatttttgtatttttagtagagaagatgtttcactatgttggccaggctggtctcaaactcctgacctcaggtgatctaccgctttggcctcccaaagtgctgggattacaagtgtgagccactgtgcccggcctggagcactctttcatgtcctctttgcctttccaaatacttcccaatcttcaaaaaccaaatcaaccttttgtgtgagggcttttcagcctgatccccctcttctgagcatttcctttgttaagatgcatgtaaggctgtgttttacttccctgggacattgctcatcggcttattttcttagttttcctcatgcttttggattgtcttgtgtgctggattggaaggccagtctaggccccccaccaggctgactcacttctctgcttacagtagggaatgagaaagggtggtatcatgatttgaactttacccagtcccacgtgtcatttgacttgagctggaaatttgcagtgtttttttgggctgctgatgtgcacaggaaggagttactggccctggacagtatgtcaggaaagctgtcctggaagaaaggaggccagacacaggccacagagggctggtgcaagcttggaaattgggtgcctaagaccttgcttttgtgttgaaaggtttgtccgatatgtgcctcgatgccctggggagaccccaactaccgcagcgccaacttcagagagcacatccagcgccggcaccggttttcttatgacacttttgtggtaagtctggagcctgggctctgatccctcccctgggggagtggcacggctacttcactcttctcaaaaggggaaatggggatccccagtgttgaactttgtcgctgttgtgatgggcttccagtctgtatactggatacagtgataaaggggattgacaagagagaaaagaagactgagtggaagaggcgggcaggcagctgtagctggggagctagatgggcttccagtctgtatactgtagctactatacagtttctattcatgggccaggcaggtggccagagtgacatttatttacttacatgagatggagtcttgctctgtcgcccaggctggaatgcagtggcgtgatctcagctcactgcagcctccacctcccgggttcaagtgattctcctgcctcagcctcctgagtagctgggactacaggcgcatgccaccatgccccattactttttgtactttcagtagagacaggctttcactatgttggccaggctggtctcgaactcctgacctcgtgatctgcccaccttggcctcccaaagtgttgggattacaggcgtgagccaccacgcccggcccagagtgacatttaagaagatgatctgggctgggcgcagtggctcacacctgtaatcccagcactttgggaggccgaggtgggcggatcctgaggtcgggggttcgagaccagcctagccaacatagtgaaatcccgtctttactaaaaatacaaaaaaattagccaggtgtggtggtgggcacctgtaatcctagctacttgggaggctgaggcaggagaatcgcttgaacctgggaggcaaggttgcagtgagccaatatcgtgccactgcactccagcctgggcaacagagcaagactgtctcaaaacaaacaagaagatgatctggtcagtctttgagacagagacagtgatacttgctctttccatctcctagccctgccaccaaatttttgtctacttttcttgtggtttatataatttctgcctgttatagaacttggtttggggacaggtgcggtgcagtggttcatacctacaatcctagcatttttgggaggctgaggcaggtggatcgcttgagctcaggagttcgagaccagcctgggcaacatgggaaaaccttgtctctgcaaaaaatacaaaaagtaaccaggtgtggtggctcctacctgtagtcctagctactttgagggagctgggacaggaggatctcttgagcccaagagacggaggttgcagcaagctgagatcatgccactgcactccagcctgggcaacagaatgagaccctgtctcaaaaaaaaaaaaaaaaaacaaaacacacacacacaacaacaatttggacttgggaggctcaatctcgcatgtccatggggaccataattgaaatgatcctcctgaggatttccaagccaggtggtgcctgactcgttatgctgccatcaccttgttttcctatggaaatgcaggcgcagcattgcctagcttctccaccccccatgcccaagcaggacaggaaaatttcacaggaggtttcacaggttttaattatcttcaaaaatacttcaggtcaaatagcatatatccactagccaaatacggctgtcaggtttatattctttccctagagctggatggtttcaaaggggcacactgttgtcttgccattatagtagtaggtaactttggccaactatatcaagtaaacctcttacttacatatatagatgtcaagttaggattttagagtggtattcggtcttgatggctgaatttcagtatctaagaaagaaagctctctgctaaattgtcataaagaatattttttctcagtctgacagtgtctgaaactcagacttcagaataactgccctttttgttaatgtgacacagatgaattacattcatctgtgtcacattaacaaaaatgactcattaaaaatgagtcctaaaaatgactcattaaagagggctagttgcgctatagtttctgctgtattgtatggctctaaaaatctgattctgtactgtgcactgattccacctctcagaaacaactcttcagctcagtgcatctgcgtgctctgttccgacagacttacaaatgttctgagcacttggtctgtgccagcctccattcgtgtgctgtctgggtttctcaatctccatttaagggaggcatccttaacttcatttaagaatcaggcagcagactgggtgcagtggctcatgcctgtaatctcagcactttgggaggccaaggcgggtggatcacgaggtcaagagattgagaccatcctggccaacatggtgaaaccctgtctctactaaaaacataaaaattagctgggcatggtggcgcacgcctgttagtcccagctactcgggaggctgaggcaggagaatcacttgaacctgggaggcagaggttgcagtgagccaagactgtgccactgcactccagcctggcaacagagcgagactccatcaaataaaaaaaaagagaaggcagcagagacagattaattttcccaaagttacatacctagcatcacaaacagttgcactggggatccggtccctggcaacctgctccggatccagttgctaggctgtcctgcttctactgaaagccagtctttgcatctagaaacagttgctgaggctgcatgtctctttttgcccttaggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattcaacacatttgccatagcatgggcttggggagtctccagaagatggttaccctttctagaagggaagttcttgcttgttgctgagtcctgtttggcgtcaaatctcagctgatgccaccagctgggcctcatggtgcctgtcctctggaaaaagaacacttgttacagttgggaggctctgggaggtgagaagtggcagcgctccatatagcaaggctttagacatgcggcttctgctacgtgcgggtaacagcagcagtgctgagggcttgtagtaaaggggctccgcagggtcaagtttcaggtcctggatgtgtttaagttcatactctgctgttagctgtggggcatctagcgaatattttctgaacctgtctcctatgaagtggggataattttatctgcctcttaaggatgctaggatccaaggagcaaagtacacagagctctccctgcacagcgctgcatcgtgggtgctcactgtagtgtttggctgcttgagcttcattccaatcccatagaaacgttattttttaattttttttagtaagagatagggtctcactatgttgcccaggctgggcttgaacccctgggctcaggtggtccaccttggccttccaaagtgctgggattacaggtgtcagtccgagcctggcctggaacctatttgttttgttttgcttttttgagtcagggttccgctctttttgcccaggctggagtgcagtggcgcaatctcggctcactgcaacctctgcctcccaggttcaagtgattttcctgccccagcctcccgagtagctgggattacaggcgcccaccaccatacccggctaattttgtatttttagtagaggtggtgtttcatcatgttggtcaggctggtctcctgacctcacgtgatccgactgcctcggcctcccaaagtgctggttttacaggtatgagccactgcacccggccctggaacctcaaatttaatacagccgagacagttcagcatctccaatcttcacccatgccttcttttgtattattccatcttgcagtggtaactacccaagccagaaacctgggaggcctcttcctccctcacatccgtgcaggccacctctgtctaagtatcagctgagtcctggacgccagttacctcagaatattgcaatttgtgcctgtttctttgaggtctgacatcctctggaaatgaagtcccgtgtcacgccaaaacaggtcgagaaaatgacactggaactgagacctgaatgaaatggggagaagcccagtgaccatgttggggaagaggattccttgcagagggaaccaagttcagaggccttaaggtgggagcccatgggttacacttgaggccctgcagcaaggaggcggctggtaagcccatggtggagtgaatgagggagagaatgaggcagcacggggcagtctggaaggcagaccagaggggctgtgtacacatggtcaggccttgggcttttctcagtgagcattcttgggttctaagtgaggtgatccagcttagattcctaaaggatgcttctggctgtgtttggagaagggactgtagtagggaaacaggaagcagagaccagggaggcggctgcaggaatccaggcagctggtgatgggggcttggaactgtgtggtgatggtggtggtgggattttgaggtagtctgacgtggtcaggtatgttttctgtgtttttttgagacaaggtctcaccccgtcacccaggctggagtgcagtggcacaatcttggctcactgcaacctctgcctcctgggctcaagcagtcatctcacctcagtctcccgagtagctgggactacaggcgtagccaccacgcccaggtaatttttgtatttttggtagaaacgaggttttaccatgttgcctaggctggtctcgaacccctgggctcaagcgatcctcccgccttggcctctcaagtacctgggaggccgaggcaggagttcaagaccagcctgaccaacatggagaaaccccatctctactaaaaatacaaaattagccaggcgtggtggtgcatgcctgtaatcccagcgactctggaggctgaggcaggagaatcccttgaacccgggaggcggaggttgcggtgagccaagattgcgccattgcagtccagcctggacaacaagagtgaaactccatctctaaataaataaaggcattctaagttctgcatggctcaaactgaactcatccaccaccttcctaccaccccacactgtgtgcttggcttctctttcccggcagacgtaaccaccatccttctaattgctcaagaattaacccacacctcatctttaactccttgtccacctccatgccccatattaccaaatcaagttaattttatttatttttatttttttgagacagattcttgctctcttgcctcaagttaattttagctcttaaataacacatttgggccagatgtgggggcccacacctgtaatcccagcacttgggaggcctaggcgggcagatcacttgaggtcaggagttcgagaccagccttgccaacatgatgaaaccctgtctctactaaaaatacaaaaattagctgggcatggtaacgggtgcctgtagtcccagctactcagtaggctgaggcaggagaatcatacgaaccctggaggcaggggttgcaacgagccgcagttacgccgctgcactccagcctgggcgacagagtgagacaccgtctcaaaaaaataacaaaaaaataatgttggcaaagcctgagtcctgtcctctcgctctccccactggacagcatgaccttcaccactcgctccaccttctccactaactacccggtccctgggttctgtccaggcgcccagctatggcgcccggccggtcagcagtatggttagcgtctatgcaggtgcccggggctctggttcccggatctccgagtcccactccaccagcttctggggcggcatggggtccggggacctggccggggggatggctggggatctggcaggaatgggaggcatccagaacgagaaggagaccatgcaaagcctgaacgaccatctggcctcctacctggacagaatgaggagcctggagaccaagaactggaagccggagagcaaaatccgggagcacctggagaagaagggaccccaggtcagagactggagccatcacttcaaaaccatcgaggacctgagggctcagatcttcacaaatactgtggacaatgcctgcattgttctgcagatcaacaatgcctgtcttgctgctgatgactttacagtcaagtaggagacagagctggccatgcgccagtctgtggagagcgacatccatgggctctgcaaggtcactgatgacaccaatgtcacttggctgcagctggagacagagatcgaggctctctaggaggagctgctcttcatgaagaagaaccacaaagaggaagtaaaaggcctataagcccagattgccagctctgggttgactgtggaggtagatgcccccaaatctcaggacgtcagcaagatcatgacagacatgcaggcccaatatgacaagctggctcagaagaacagagaggagctggacatgtactgatctcagtagattgaggagaacactacagaagtcaccacgcagtccaccgaggttggaactgctgagatgactcacagaactgagacatgcagtccagtccttggagatcgacctggactccatgagaaatctgaaggccagcttggagaacagcctgagggaggtggaggcccgctatttcctgcagatggaacagctcagtgggatactgctgtacctggagtcagagctggcacagacccaggcagagggacagtgccaggcccaggagtaggaagccctgctgaacataaggtcaagctggaggctgagatcaccacctactgccgcctgctggaagacagcgaggacttcaatcttggtgatgccctggacagccgcaactccatgcaaaccatccaaaagaccaccacccgccagacagtggatggcaaagtggtgtctgagaccaacgacaccaaagttctgagacattaagccagcagaagcagggtaccctttgggaaacaggaggccaataaaaagttcagaggtaaaaaaacaaaacaaaacccacatttgtgttttcttatcatcccactggcacctacatttttttttttttttcgagatggagtcttgctctttcgcccaggccagactgcagtggcgctatctcagctcactgcaagctctgcctcccgggtccacgccattcttctgcctctgcctcccgagtagctgggactacaggcgcccgccaccacgcccggctaattttttgtatttttagtagagacggggtttcaccgtgttagccaagatggtcttgatctcctgacctcgtgatccgcccgcctcagcctcccaaagtgctgggattacaggcgtgagccaccgcgcccggccggcacctacatcttaaaagccactgtgatctcatctgaaatactgccacaactttccatttgacctctctccattgctgcccagccaacatccagtcctccgccaccaagcagccagaaggatcttccaaaaatccaaatgtgaccgaccatatcctttaaaacccttcagtggcttcagttaccctcaaagccccacacctcacagggtcctcaagaccctgtgacctctgccaactgcctacgtctccaacgtcggcttcttgtgaaaggtcagaatcaaaacgtagtcaccagtattaaacaaaacaaccctgacaccaagagcgaaactccgtctcaaaaaaacccccaaaaaaccctgacacagagtcagggaaggctatgcagtgaatgcttgcatgcctgataacaaaaaccatcacaaaagactctgcaaaaacacaaccttgcacaaaggccatcgcaatgcaactttttttttttttttttcgagacagtttcactcttattgcccaggctggagcacaatggcatgatcttggctcactgcaacctctgcctcccaggttcaagcgattatcctgccttagcctccctagtagctgagattacaggcgcgcagcaccatgcccgggtaatttttgtgtttttagttgagacagggtttcactatgttggccaggctggtcttgaactcctgacctcaggtgatcttcccgcctcagcctcctaaagtgctgggattacaggcatgagccactgcacccggcccagaatgcaactttatacaaaaaatacttctacaaggacatctgcccagcaactgcctgtacaacctcacgctgccttcacccttgttaatgatctttgtagccaaagataaattttcaaaaaaattatgtgcccagcgcagtggctcccgcctatcatcccaacattttgggaggcccgaggcaagaggatcgcttgaggccagtagttagagaccagcctggccaacatagtgagatctcgtctttgaaaaaaaaattatttttaattatgtaggctgggcacggtggctcatgcctatagtcccagcactttgggaggcagagatagaaggattacttgagcccaggagttcaggaccaaagccagactaacctcaaaaaaaaaaaaaaaattagctgggtgtggtggcacccgcctctggtcccagctattcaggaggctgaggcaggaggattgcttgagcccaggaggtcaaggctgcaataagccaagattgtaccactgcactccaacctggatgacacaacgggaccctatctcaaagataaaaaaaaataacaatttttaaaaagtaaccctcattttgtcctttaaacaactttgtctgttccatagcttggttgatacttgatcatcaaaaagaaccaacctttgtctatccaggtgtggtggcacgtgcctgcagtcccagctactcaggaggctgaggcgagaagatcacttgagcccaggagttcaaggcttcacggagctatgattgtgccaccgcactgcagcctgggcgacagggggaacttgtttcaaaaaacaaaacaaaagcttttgtcttcctttacctccctgaatatgcagtagtttgctatgacaaatgtattcccatggtaatgctctattcccgactaaatatctttttcttctagggagcctctctctgttatttaggttgacatatatggtgtcagaaatgggacctgaaaaagattagtactggaagaaatcggtgattcttggaactggtgtacagtattcactagagccctttgagcgcactgcttccatggctccccttttctgccctggtgagtcttctctcaggttgagcctccctctttttggtagaggcttttttgttttgttttgttttagagacagggtctcactctatcccctagactggaatataatggcacaatcatagctcactgcagccttgaactcctgggctcaagtgatcctcctgcctcagcctcccaagtagctgggactatagacgtgccaccacacccacctaatttttttttttttttttttttttgtagaagcagggacttgctatgttgcccaagctggtcttgaactcctggcctcaagtgatccgccctcctcaggctcccaaagtgctgggattacaggcgtgagccacatgcctggccaaaagtgtgcgctttttttttttttttttttttttgacggaatctcagtctttctcccaggctggagtgcagtggtgcagtctctgctcactgcaagctctgtctcccgggttcacgccattctcctgcctcagcctcccgagtaggtgggactacaggtgcccgccaccatgcctggctaatttttttgtatttttagtagagacggggtttcactgtgttagccaagatggtctcaatctcctgacctcgtgatccgcccacctcggcctcccaaagtgctggaattacaggcgtgagccaccacacctggccaaaaaatgtgttctttattgaaaataaaagaataattttgtttaatttggagattatgtaagttttttgaaaatatgggctggctgggcgcggtggctcacgcctgtaatcccagcactttgggaggctgaggcgggcagatcacctgaggtcaggagtttgagaccagcctggccagcatgatgaaaccccatctttactaaaaatacaaaaattagctgggcgtggtggcacgtgcctatagtcccagctacatggaaagctgaggcaggagaatcacttgaacctaggaggaggagcttgcagtgagccgagattgcgctaatgcactccagcctgggcgacagagcgagactctgtctcaaaaacagaaaagaaaaaaaaaagaaaatatggacttatgaaggaaatagaaacaagatagtaagaaaaccaataactgagagacagagatatgaaggaagttatggttatgaagatatattttttaaaaggaaagttgaaaagaataattttgtatgggaaagagtctctggtaaatttatgttctaaagtaaaatgattggtatttaatgaagaggaagtataagacagggcacagagtcaaagcacatcatcaatggtctgaataagtcatgatggtgttcatgaagggagaacttatgaaaggcattttgtgtgtcatcaagttggctataattagaagggaattatttctacgtctttctaaagatagattaaaaatacactgatagaaaactaaaaaattcatatcccctatgttaaaacaactaggttttcttttttcttttcttttttttttttgagacggagtctcgctccgtcgcccaggctggagtgcagtggcacgatctcagctcactgcaagctccacctcccaggttcacgccattctcctgcttcagcctcccgagtagctgggactacaggtgcccaccaccacgcccggctaattttttctattttttagtagagaccgggtttcactgtgttagccaggatggtctcaatctcctgacctcgtgatccgcctgcctcggcctcccaaagtgctgggattacaggcgtgagcccctgcccctggcccaggttttcttcttctttttttttttttttttctctgagacagagtctcgctctgtcacccaggctggggtgcagtgtcgcgatctcggctcactgcaacctccgcctcccaggttcaagcaattctccgtgtctcagcctcccgagtagcttggactacaggcacactgccacgcccacctaatttttgttattgttgttgttgagacagagtcttgctgtgtcgcccaggctagagtgcagttgcgtgatctcggctcactgcaacctctgcctccctggttcaagccattctcctgcctcagcctcctgagtagctgggattacaggcgcacaccaccatgatttttagtagagacagggtttcaccatgttggtcaggctagtctcgaactcctgacctcaggtgatctgcccccctcggcctcccaaagggctgggattacaggcatgagccaccttgcctggcaggttttctttttcttttaaatttgtatttattttttgttgtagagatgggaatctcactatgttacccaggttggtctggaactccgggcctcaagcagtcctcatgtctcagcctcccaaagtgctgggattaacaggcctgagtcaccacacccaagccaattaagtctgtttgaactggaatgaacttagggattttgcagttgggccagtggagggcctctaatgatgtatttctcagcttgtagagatattaaatgattaggtttatctggtaagttgtacaggaagcattgtcaagtgataagtgattctattactagatctttcagttacatttatgggtctgttattgatataaatatttcaaaaattatataaattcatagatacctaatattatctgtcataattttggttatgttaatctcttctaaagttaaatttatctggatattttattaatgtgagtttgtttttttttttgagatggagtctcactctgttgcccaggctggagtgcagtggcacgatctcggctcactgcaagctccacctcccaggttcacaccattctcctgcctcagcctccagagtagctaggactacaggcgcccgccaccacgccaagctaattttttgtattttgtttagtagagacagggtttcaccgtgttagccaggatggtctcgatctcctgacctcatgctacacccgcctcggcctcccaaagtgctgggattacaggcgtgagccaccgcgcccggccgtgaattttttttttttttaatttgagacagagtctcacactattgcctgggctggagtgcaatggcacagtctcagctcactgcaacctccgcctcccgggttcaagcgattttcctgcctcaacctcctgagtagctgggattataggcacccacgaccagcctggcttattttttgtattttttagtagagacagggtttccctatgttggccaggctggtctcgaactcctgaccttgtgatccacccaccttggcctcccaaagtgctgggattacaggcgtgagccaccgcgcccggccaattaatgtgaatattctaaagattatattcaatttataaaagtctgatgtttcttgtgtgactgtgtcagtcatgattctggttgttatcttaaaatactgtatatggccaggtgcagtggctcatacctgtaattccagcactttgggaggtggaggcaggagggatagcttgaggccaggagttctaaaccagcctgggcaatatagcgagactccacctctataaaaaattagccaggcatggtgatgcacccctgtggtcccaactactcaggaggctgaggaccctttctcttttagagagcctctctctctgttatttaggttgatattttcacatctacttctgcactctttttactccaaccacacgggccttctttttttttttttttttctttttttgagacagagtttcgctcttgttgcccaggctggagtgcaatggcgcaacccaacctgcttcaccgcaacgtctgtctcccaggttcaagcaattctcctccctcaacctcccgagtagctgggattacaggcatgcgccaccatgcccagctaattttgtatttttagtagagacagggtttctcaggctggtcagactggtctcgacatcctgacctcaggtgatccgcctgcctcggcctcccaaagtgctgggattacaggggtgagccaccgcgcccagccccatacaagtcttctttctgcacctcaagtgggtcatgttccccacctcaaggagtacacacgttccctttcctctggaatatttggtgccccaggcccatctttgccttttttaaaaattttttttttcagatagggtcttgcttcattgcccaggctggagtgcagtggcaccatcacagctcactgcagcctctacctcctgggctcaagggatctgccttgtcctcccaaagtactgggattataggcacaagccaccgcacctggccaaatacttttttagtataaatattttccaaatattgcatacgagtgtgaataatttgcacaagcaggccaggaagtaaatgccaggaatgttcatcctaaaaattatttgctgtttatctgaaattcacagttaactgagcattctgtatttttattggttaactctagcaaccctactcgacatgtttgcagaacaaatgttctgaacatctgctctgtgccaggcaactcacaccttctcattaagttatttgtccaattacaagaaattaagctcttgagggtaatggctgtgtctgtcttatgcaccaccggcctccatgcctgaccccgggtagactcaataaatgttcctagaattgaaatagaactaaaaaagaatttccagtggttactttctttccatggcagcttgtccaccctggaaggagtctggtgcagcggtaaggagagcctgaagggggcagtgtcaccccctggctctggcttcctgttgtccatcaccatggggaggcagggcctcaaatcggaagcacatgaaactggaacttggaaggcagaggaggcaagacaggtgggcaggcaagatggctactgccaggtggggtctgacctgctcaggtcctcaatgtggtccctttattcctcccttgttactccttggctttctgcggtgtcttctgctgaatgtctcatgcagggctcagctgggccctatgaatacaagaatagcaacaatgatggtaattattttcattcctggttcctgacaataattttgatttaatcctccccactttaggccctgaaaggtgatcaaaaccaggcattcagtttctccaggaaagtggatctcatggaattatcttagccagcattggtggagggatactaaatagcattacctttacagatgagggaatggagcccagagaagctgaggtcatttgcccaggacaagaagtgagacttgatattccagtgcagaggtgcgattagatgtatagtcccccacacagactgtgtggagtctcctattcccagcatccacactcactagctgatctaggggtcagctgatcactcactagcttgaccttggacaagttattctaatctgtgcttatctgtaaatggggctaataagtgtctttctcgtagagttgtgggaatttagtgaaataatccagagcatggcacaatgtaagtgcttaatcaatgcgagctaccaatgtcactattgtttgtcccctccattcctaagccctcccagggcccaaccccaccccagcaggctagctgttaatgtttgatgactaaacattactatgaagtgaagtgattccctaatttggcctgaagagatgaattacctggaaggcactcgctacagaaatctattctcaggtccctgccttagagattctaattggtggggcctgggaatctgtatctttaaaaaagcctcgggtgaaatctatctgtaggctgatttcgaaagtccttatgtaatgtaaaaccggaaagacagggcgcggtggatcatgcctgtaatcccagcactttgagaggctaaggcagttggatcacaaggtcaagagatcgaggccatcctggccaacatggtgaaacctcatctctattaaaaatacaaaaattagctgggcgtggtgacatgcttctgtagtcccagctactctggaggctgaggcaggagtaatcgcttgaacccaggaggtggagggtgcagtgagccaagatcatgccactgcactccagcctggctgacagagcgagactcgtctcaaaaaaaaaaaaaaaaaaaaaagaccggatagtgctacagcaaacacattgtgacaggggtggggtggaggcgcccggtgattagaatcggtggactagctcagcccttacaggttacaagaatttaaagtgatgattaccttttctgattataaaaatcatctagggctgggcgtggtggcttacacctgtaatcccagcactttgggatgcctaggtgggaagatcacctaagcccaggagttcgagaccagcctgggcaacatggtgaaaccccgtctctacaaaaaaatgtaaaaaataagccagacttggtggcacacacttgtaatcccagctaggaggctgaggtgggaggatctcttgagctgaggaggtggagggttgcagtgagccaagatcccgtcactgcaccccaggctgggcaacagagtgatacactgtctcaaaaaacaaaacaaaaaactagtctatttacatggtctcagatgatcacatacattatttagaaagggaaaattagtgactttgtagaatcactgctagtggcgaaacctagctaatcccatcttaactaagcgatgaaagttactatcacagataatggaacagaccatagatgactcaatgggatgcactgaagaggcagcaccacttctgtggttccaggcaggaaaacatacaagctcagtgtcatcataaggaagcaccaggcaaatgcaattgagggacagtccacaaatcttccaaaatgtcaacatcagaaactacagatgcctgacaacactgcaatgctgcatgatcctgaattgaatctttgagggtgtgggggttgctataaaggatgttattgggccagttgaatatggcctatggaataaggaataagtaattgatccatgttagatttcctgattttgataatgatatcagagttacataatagaatgtccttgttcttagcagacatacagtaaagagtataggggtaaaggggcatgacatctctaatccactctgatatggtttagaaaataatagtgtacgtgcatataaaaatatatatacacacacacatgaacacgcaggtaaggtataataaagtaaatatgcaaaaatgcacagtgttaaaaattataatgccccttgttaaaaaaaaaataaccgggaagaaaaatataaagaagaaaatggaagccactcctactcctacccccccgcccccctttccctccctgcctcccctatcccccgtccctgagacaaccaggatgactatttcaatcagcagtgaaactcttacatgtctttgggtcgttttatatatatgtatatatgtgcatatatatatatgtgtgtatatgtgtgtgtgtgtgtgtgtgtgtgtgtatatatatatatatatatatatttttttttttttgagacagagtcttgctctgtcacccaggctggagttcaatggcacgatctcggctcactgtaacctccgcctcccagggtcagggtcacagggtcaagtgattctcctgtctcagcctcccaagtagctgggattacaggcacatgccgccatgccaggctgattttttttgtattttagtagagacagggttttaccatgttgccctggctggtctcgactcctgagctcaggcaatccacccgccttggcctcccaaagtgctaggattacaggcgtgagccacctcacccggcctggggcattatatttttgattgaaactgaaatgcgtgaatgctttactttccatctataagttgtgtttttcactctgatgtatgtcaatatctttccatgttaatgtgctggtgtttcaaatggctgcatgatgctgcctggtagggacagagcatactttgtttatcaataggtgtttaggttgtttccagcttgactcctacagacagtactagagtgagcatccttaaaaatacatcttccccaacttgtcagattattttgtttgcagagctgctgggtcaaaaggagagagtctctgagaagggacagaggctgacagtcggggagactgcaagagaaagactgagagagagagagagatctatagaagcagagagagggggaaagaaacagatggagagagacagaggctgggtgcggtggctcacgcctgtaatcccagcactttgggaggctgaggtgggcagatcacttgagttctagagtttgaaaccagcctggccaacatggcgaaaccctgtctccgctaaaaatacaaaaattagccaggcttggtggcacacgactgtagtcccagctactcagaaggctgaggcacaagaatcgcttgagcctgggaggcaaaggttgcagtcagccgaaattgcaccactgcactctagcctggccaactgagtgagactctgtctcaaaaaaaaaaaaaaaaaaaaagagatggagagagacgagaaagagcaaggttgagggttgagagagagcgagattgggagggtgacagggagttgctttcgatggagactgagaaggaattcctctgacccatggggtctctatggccacaggaatccagtcaggaaagtgactaagtgacttttaggaacacacccaacagatacaatcgtagatgaggtcagagtcctttgtgcaaggatcttcatggggctattgttcctggaaagcaaaaaatgggaaacgacctaattgcccatcaacaggggactggttatagattgtgctggaaatgctgatagaagcccatctccaagtagggttggcagataatagcaaataaaaccacagaaggcccagttaaatttgaatttaaaatgaagcatatgtctcatgcagccttccttatacactaaaaacctatttgttgtttatctaaaattcacatgtatattttatctggaaactattaatctccaagataagtgagaaaagccaggtgaggtcaggagaggggttgctcttggtgagggtgtgtgtgtatttgggctgctgaggtggccgtcagtttcagctcctgtcctgggtgtggttacacttgaagggaagggactgatccgggctcacataagcagaggttgaagggctaggctccactccagggtccgtgctctgtagtgatttgtatatatgtgttaaaagtgttttcaataaaagtatgacagaccacaattttctaaactccatttaaacatttctgatttaaaaaaataatactagcagtctcagctgggtgtggtggctcacaccagtcatcccagcactttgggaggccaacgcgggtggatcacgaggtcaggagttcaagaccagcctggccaagatggtgaaaccctgtctctactaaaaatacaaaaattaaccggacacagtggcaggcgtctgtaatcccagctacttgggaggctgaggcaggagaatcacttgaacctgggcggcagaggttgcagtgagccaagatcacatcattgcactccagtctggacgacagagtgagacttcgtctcaccaaaaaataaaataaaataaaataaaacaacaacaacaacaaactggcagtctcagaaactctaaggggcctccctgaacattttcatttcctggaacactcatctgcccctgggcttttttatcactgtcgcctggaatgccctcttaccccaccccacccccaaccccctcattcacctgctcatgcctgtgacctcaacctggagtcagcctggttctcactcctctgagtcaccttaggtgcctcggagttgcaagaacactgaaccagctgttaccccctttcccccctcgcctgtgagctacgcaggtgcaggaaccttgtctgtgtgcagctggtttatcacagtatcctagcccattcagccaggtacatgccacagcttactcactacaccttggacatgttagtaaagcgtctctctgagcctcagtttcctcatttgtaaaatggagctgatcatcttgcctaccactcaaggccaatgtgacagagatgggaaagggaaatggcattagcatcactaaggtaatatttcaactgaggccagcactgggaagatctggggaagggtattccaggcatccttgggaaaaaaaaggagactgcgggcagccgtgagagccaggtcactgcggtctgtgtggcagccaagtccctaagaaaaaaaaaaaaaaaggagtttgctctcattttccccttcttgccaatacctctcacctgctgtgggtcaaaggtgcacaaagctctacaggtatgcaaggtaggtgcaggtaggggagccaggagaccctggggctttcctggaggcaggttcagccttctgcgaggaagatggagagagcagggctctatcagtgcagtctgatgggtaaggggcctaggcccgagacagtctgcgagcaagtgtgcgtgtatgagcccctgagcccgcccaccctgcaagtgcctggagactcactggggaaggtgtgttttgcactatagagacatcccaatggcctatctcagtccttgagctccagaggcatccatctcccaggcgtagagctgggctctggcaggtgtgtgatcggactcgggcaggtgcagagaggcctggcttcagggcccagctcagcccccacatgtccaccctcgaaggcttccacagctttctgttttccaaggtgaccacgtcatcccactttgtccaggattgccccagaacaccctcactgccaggcaaactggactggttggtcaccagacatattactccattggacagaggaagaagagtctcagaggctgtcagtatctgcctcattttttggggctgggtttttttcatgaaaagtttatttgaaatggtgacacatatatctgaaataaaacattcatattctttaaaaaaggcttctaggccgggcacagtggctcacgcctgtaatcccatcactttcagaggctgaggcaggtggatcacctgaggtcaagagttcaagaccagcctggccaacatggtgaaacctcatatctactaaaaattaaaaaaaaaaaaaaattagctgggtgtgatggtgcacacttgtagttccagctacttggggaggctgaggtaggagaatcgcttgaacccaggaggcagaggttgcagtgagccaagatcgcaccactgcagtccagcctgggtgacagagagagactccacgtcaaaaacaaaaaacaaaaaggctcctagaggccgggcgcagtggctcacacctgtaatcccagcattgtgggaggccaaggcaggtggatcacctgaggtcaggagttcgagaccaccctggccaacatggcaaaaacccgtttcttaaaaaaatacaaaaattagttgggcacggtggcaggtttctgtaatcccagctcctcaggagactgaggcaggagaatcacttgaacccggggaggtggaagttgcagtgagccgagatcgagccactgtactccagcctgggcaacagagccagactgcatctccaaaaaaaaaaaaaaatgcttgtagaaaaagaagacatctttctaccccaccctgctcctgtcctctgaagcagtcagcttcttggacctctcagagacagatattatttacttctgcacaaaaggcagcctattacatatgctgttcatctgatatatttttttaagagatgaagtcctgtgcttgcttcagcagcacatacactaaaattggaatgatacacagaacattaatgtggcccctatgcaaggatgacacacaaattcataaagcattccatatttttaattaaaaagaaagagaaagaaaaagcaacggagtcttgctctgtcacccaggctggagcgcagtggcatgatcatagttaactgcagtctccaactcctgggctcaagggatcctcccacctcagcctcccaagtagctgggactacaggtgtgtgccactatgcccaactaattattaattttgttgttgttgacacagagtcttgctatcttgcccaggctggtcttgaactcctgggctcaactgatcctcctgccttggcctctcaaaatgctgggattacagccgtgagccactgcacccagcccacttgaattttttcttcttcttcttttttttttttaacacctgatatttttttcagttaaaaatatgagttccggcagggcatggtggctcatgcctgtaatcccagcactttgggaggccgaggcgggcagatcacctgaggtcaggagtttgagaccagcctggccaacatggtgaaacctcatctctactaaaaatacaaaaattaccccagtatggtggctcgcacctgtaatcccagctacttgggaggctgaggcacgagaattgcttgaacctgggaggcggagtctgcagtgagctgagatcatcccactgcactccagcctgggcaacagagcaagactctgtctccaaaaaaaaaaaaaaagcatatatatacatacatatatatgtatatatacgcacacacatatatatatatgagttcattcatttcattcagctaataattactgaaccagaccctgttcttggtgctcaggtcatagtagcagacaagacaaagttcctgcctgtgtggagctgtctagagcagaaagtgaatgtttaggttttgcagacttaaatagcaaggatgttatgtcagtactcatataacaagagaaaacaaattcccacaaaatttttatggacaatatttaaattataataatatttgagtacaattttgtttttcatttttttaatttaatttttttttgaggcagggtctctcattgtcacccaggctggagtgcagtggtgcagtattggctcactgcagcctcgatttcccaggttcaagcaatcctcccacctcagcctcctgagtagctgggactataggtacacaccactacacctggctaatttttgtatttattttttggtaaagtcagggttttgccatgttggccaggctggtctcaaacttctgaactcaagcgatccacccttcttggcctcccaaagtgctgggattacaggcgtgagccaccgtgcccagcctgtctgtttttaaaatataaataatagagatagggtcttgatacattgtccaggctggtctggaactcctggactcaactgatcctcccgccttggcctcccaaagtgctgggattacaggtgagaggcactgggcccagccagttttttttgtaagcatgaattattattattattattattaattcaagacagaatctctgttgtccaggctggagttcgatggcacaatcaccgctcacagcacccttgacctcctgggctcaagtgatcctcccacctcagcctcccaagtagctgggactacaggcacatgccaccatgcctggctaagttttgtactttttgtaaagatgaggttttgccattttacctgggctggtctcgaattcctgggctcaaacaatccgcccgcctcaccttccaaagtgctgggactgccggcatgaaccatgaggtccagcaagcatggaattttgaaggttcacatattgccttaattgaggttccaagtaactgttatctaccattaaatcggttgcagtgttcatctgtagaagctactcttagctcaaggaccatacaagaaacaaaccttggtcagatttggcctgagggctgtagtttggcaacctccagtctaaagggaaatcaacaaaatcagtgaaacatacaccatgccagattatgagcgaagtggagaaaaactaagcagcaagaggggaaggcgtgccagagggaaagggaggagagggggatgaagtggtggcctgggaggctttgctgcgatggggggtgagccctgtggctatatgggagaagagctgggaggagacagggaacaccagatgcaaggtccccaaagcaggagcatggctgatgtggtttgccctgcagccggagccttgtgggcgatagtgagtatgggggctagggtggggagctcaaggggccacagggggccaatcctgtagggcctcgttgtgggccatagtgaaggctctggattttcctacaagagagctgggaccagggagggtttatgtacccacagaacagcatcgacatttttttttttttttttagatggagtcttcctctgtcccccaggctggatggagtgcagtggcacgatcttggctcactgcaacctccgcctcctgggttcaagcaattcttctgcctcagcctcccaagtaactgggattacaggtgcctgctgccatgcccagctaattttttgtatttttagtggacatgaggtttcaccatgttggccaggctggtctcgaactcctgacctcaagtgatccacccactttggcctcccaaagtactgggattacaggtgtgagccaccgcacctggccgagcatcaacataattttttttcttttttttttgagacggagttttgctcttgttgcccaagctggaatgcaatggcacaatcttggctcactgcaacctctgcctcctgggttcaagtgattcttctgcctcagcctcccaagtagctgggattacaggcatgcaccaccatgcccagctaattttgtatttctagtagagacagggtttctccatgttggtcaggctggtctcgaactccgacctcaggtgatccatccacctcggcctcccaaaatgcagggattacaggcatgagccaccatgcctggccaggcgtgaacattttaacagtcgtgaaagattccattgatgcgcctgttttacactcaacagttcctctatcatggacgactttttttttttttttgagacggagtcttgctctgtcgcccaggctggagtgcagtggcgtgatctcagctcactgcaagctctgcctgttgggttcatgccattctcctgcctcagcctcccgagtagctgggactacaggcgcctgccaccatgcccggctaattttttgaatttttagtagagatggggtttcaccgtgttagccaggatggtctcgatctcccgacctcgtgatccgcccgccttggcctcccaaagtgctgggattacaggcgtgagccactgcgcctggccgtatggacgacttttgctaccctattaaaaattaatccaattgtccagattcgtggctcacacccgaattccaatactttgggaggccgaggagggaggattgcttgagcctaggagttcgagaccagcctgggcaacatagcgagacccagtctctaaaataataataataataatgccgataatacttgtaaatgataaaaaataaaatcaagacatgggaaaggatatttagtaaagaatcttccttccacccctgctgacagctaccagcttctcctcagagacaggcacattaccctctctccagagatggtttaatgtcctaagaaatacctgtataatggtgttttgcaccttgctttttttttttttttttttttttgagacagagtcttactctgttgcccaggctggagtgcagtggtacaatctcggattactgcaacctccacctcacaggttcaagccatgctgcctcagcctcccaagtagctgggattacaggcgcacaccaccgtgcccaggtaatttttttatttttagtagtgacggggttttgccatgttggccaggctggtcttgaatgcctgacctcaggtgctccacttgcctcatcctcccaaagtgctgggattacgggcgtgagccaccgagcccggcttgcaccttgctttttagcacttaatatcttgatatgatttcattacatccagagctttttccttcttttcggggcagatgggtaatgtattcattggtccccgcatggcctcggcctgtatgcaggagcctagaatacaactttgggatgctatagggacatccctgaggtgagcctcctacaacgagcctggcacccagcaggtgctcagtaaataggaatgaaaaggctagctgtaatactagtactttgggaggattaggtgggaggtttgcttgagcccaggagtttgagactagcccgggcaacatagtgagacccccatctctaatttttaaaattataaaaaataaataccattttacaaaggcttgtatagcttatcttggagcctccccccatgggtcatgcccaacggacttagaccttgacccagaaacctcccttagaagcaatttgtattctgaaatggtgacttcacagagggcttattggataaggcccacggctgaatcactgtttgtttttaggcaagtgtgaggcataggaagaggttaaatccaggatgaggatggcagtagagcattgactcattcattgaactttctgtagacaatgtctttctcctggtcaagattaactttccaactcctgatcaattcattcactgataatgagctaatcaacaggggccaccagtctaataaagagctcttagaaattaagaagttcattcactggaaggacatgcaggattttaaaaaaggaaagaaatcaagttcatcaatttggtgaccaaaggacatgaagcaatagttcagagcacagagaaacagaaatggctttggtgtatgtaaaaaatgctccacactgccgggcgtggtggctcacggctgagtgcggtggctcatgcctgtaatcccagcactttgggaggccgaggcaggtggatcacctgaggttggcagtttgagaccagcctgaccaatatggagaaacctcagctctactaaaaatacaaaattaggtgggtgtggtggcacatgcctgtaatcccagctacatgggagggtgaggcaggagaatcacttgaacgtgggaggcggaggttgtggtgagccgagatcacaccattgcactccagcctgggcaacaacagtgaaactctgtcgcaaaaaaaaaaaaaaatgctccaccctagtcatgtgaaatgcaaatgacaacaggagatcccattttcccttatcagacaggcaaagataaaaaagttaaaggccagcaaggtggctcatgactgtaatcccagtactttgggaggccgaggcaggtgaatcacttaagccaaggagtttgagaccagcctagacaacatggcaaaacctcggctctacaaaaaaaaaaaaaaaaaaaaaaagcaaaagacaattagccagatgtgatgcctcgcacctatagtcccagctactctggaggctgaggtgggaggatcacttgagcctgggaggcggtggttgcagtgagcagggattatgccatggcactccagcctgggtgacagagtgagactgtctcaaaaaataaaaaatagacagggtcaggtgtggtggctcatgcctgtagccctgtagtcctagctgctcaggaggctgaggtaggagaatcacttgagcccaggagatggaggctgcagtgagttatgatcatgccactgcactccagcctgggcaacatagcgagaccctgtctcaaaaaagaaaaacaaaaagacaatactctgtgttgggcaacttttgaaaaggggccctcaactccctgctagtgggagtatagttcagtttcatctttttggatggcatttggacaaatgtatcaacattttatataacataccatttgatgtgaagtgcaatgatgtgtgtagagggcattcattgaaattgccacattatttgtagtagccaataaattgcaatctaacctaaatgcccatcatgagtcttcgtgttaggtaaattgtgtgattgtgctataatccatacaatgaatagtccgcatccctgcagaaaactaagggagctgcgtgtaatgatatggaatgattttcaaaacactgaatattgttatagcattacccatgtgatgacgattcaaaacaaaaaaatgttactatagcaaggtgtaggttagtgtggaggttcctatttgtaatacataaagggctgtacatatatacatatatatatatatatatatatatatatatatatatatatatagttaaagacaggatctcactctgttgcccaagctggagtgcagtggtatgatcttggctcatggacgcctctacctcccaggctcaagtgatcctcccacctcagcctcccgagtagctgggacaacaggcatgtaacctgcctattttttgttttgttttgttttgtttttttgagacagggtcttgctatattgcccgggcttgtctcaaacttctgggctcaagcgatcctcccaccttgacctcccaaagctctgggattacaggtgtgagccaccacgcactgcccatgcacatattaatatatacataggccatccctggaaggtcatacaagacactggtttaaaaaaaaaaaaaggttgctttggggagggaaaaggaggtctggaatggagggagactcttcttttagttgggtaactgtaaatcacattatttagctactggttttacttctagtgggagattggcacctgcagaaaatgcaggtgtctattcaaatgtaccttccttccagaagcctttcgtgagcacactaggtattcccagattgccctcccggcagttataccagccttcacctccctgaaaagcacgtgccccctgcaccccgcgacgattgcagggaggcgccttggccagcagagggcgccagaggaccgcgccccaggcctggggcgggaccccctcgtgcggggagctggggagggcctggccctgccgggtcccaggccacctgggccgcagatgtcgcccatttccgggaggacctgaccccacagtatcaaaagtgtcacctcaccttcccctgcaaagggagctgggtctgcggccgagaggcctggcccgaagcctcctctcacctcgtggtctccgccgcctgcaggagggagtggagcgagggcgggcctggagggggtggcggggacaattcgatccgatctgagcaaggcccctcccctctgcgttgcctcccacccccatgccccgcgcaggtgcctgaccactgaaggaaagtggaaagcgggaggcccaggcagtggctgcctgcaagtacttgattgagcccccattatgtgctttgaagaaaacagaataagacaatgagagagaaaggtgggctgggcgcggtggctcactcctgtaatcccaccaagttgggaggctaaagtgggaggatcaattgagccgcagagtttgagaccagcctgggcaacatagtgggaccccatttctacaaaaaataaattagccaggcatggtagcgcgtctcagtgaaaaaagggggaaaaaaagaaaaaagaaggtgggtgctggggcaagggtgggtcctactttggctagggtgatcagggaaggctcccctgaggaagtgacttacattttttgtgttaaatatattattcatacctaaaagtgtttaaattgtctctgtacactaccatgtcatgaagatacggtaaaataaatagtccatgtacagtagaaagactaacaataaagatccctccctgcctaggaaacagatcattaccaaaattctagaagcttcatgtgcagcctgttcttgcctcccctcctcaccagccactcttcagaattttgtatcaaacatctccttgcagccggcatagtggctcacccctgtaatcccagcactttggcaggctgagctcaggagttccaggcggcagtgagccgtgattgtgccactgcactccagcctgggtgacagagcaagaccccgtctcaaaaacaaaacaaaaaaccacttccttgcttttctttctaattctacaacccccacatacatccctaaataatatagggtttcatttgcctgcttcagaacctcgtataaatccaaataactatgcatttgtttgtgacctctgctcgacattgtgtttttgagattcatccctgttgctgcatggagttgtagttcatttttattgctgtatagtattctattacaggattgcaccagggttcattaatccagtctactgtttataaacatttgtgttgtatccagttttgttttagtttttgctttttttgctattaggaacgagggtacaatgaatatccttttttgttttttcggggtttgggctggacaacagttctttactttgcttggttgctcattataatccccaggggagttttttaaaatgctgatgccagaggccccacccagactaattaaatcaagatgtgggtgggggtggggtgggccgaggcttaggtgttttaatccttccctgtggggatctaatgtgctgccagagctgagaacccctgggatgcagttggtttgaggacagacttgtcagctgcagcccctgggatgcagttggcttgaggacagacagggagaggagtcacctgttgctagctgatgccaaacttttccaaagtgactatgcccaccgaccctctcgccagctctcacctcctcatcaactcttgatagtgaccaaatttttccttgttgtccttctgatgggcgtgaaatggcagctcactgtggcttgaatttgccatttctctcttcactaaacgaggctgagcagttagtgaagttgctgctgaaacaaagaatgaaaggaagccagcgtgaagatctaggagcaagagacgtaggggagaggaggaagagcagcaggtgccaaggtgggaaaggtctgggatgttggaggaacagaaggaaggctgggggtgggatccttgtgcatgggggagggagagaggctcaagccaatgtcagctggggtcagagcagcggggccgagttggctgaggagaggactttggcttttactctgagacaggcgcatgggagggtttgagcagaggagggggtgatctggcctcactttggcttcaagcaaaggatcctgattggagctaaattgacacgggacggggagtattccgcttaatgactgcttactgcctctgtcccccaccctactgcccgctctccagctagaaccaggggaggacgattttgttcacggctgtcacacccggcaccaagtgactaaacagacagtagttctgcccttcaggttggtggtggtggtggtgtggggtgcttataggtttttatagtcttccttcacaggtggaaacaagaacggtgagacctgtgaggtttatttcagagccacccccgggcctggtacgcctcccagggaagctggggtgggggtgcagctgcccctcacttgggcccaccccacatgcattcagtcagggcccctatggagccgtgttacagcctttagacacaggatcgaggatcttcacggggtgaggagacacgcccggcccatgccttctttctcccgccagcctacagggatctttttcaacgaaactctaaccaggtccctcctcagctgaaaatccttcggtggctccccagtgcccttgaggcaaagtccaaactcctacgaggccctggggcccagcacatctgacccctccgggcatgcccatcccaccccatccctggaagctgctctctaggagttactctgaagcagttgccacttcttccctcgggccttttcccttgataattcttcacttcctctgggaagtcaccccgaccccctgtcaggtgacccgcctcttaacggtcgccgcgtcccgtctctcccccaccaaagcacacttccctttgcattgtaattatctgtttacttcgtctgtctccctcactggaccagaagctacccttcgggagaggctctgagtgttctgtccggggctgtgccctggccccaggtacagtgccccacacgtgctgggcgctccgtaaacactggataagggaaggaacgggtgctcttggctagctgggccaggctgctttgcaaaaaggccgtggcatttcaagccgccgagagccacgtgcggtgtccctttcctcgcttcctccccagtgatgtgcgtttccctcgtcaatgccacgctctccaggcgccagccgggcggaggaaatttccgccccctcccaagcccgaggcgggggcgggcgtcggaaggtcaggtgtcccggccggcgcgcagcgccagggggcgtcagaagcgctcagaccaccgggcgctgagccggtgggcgcgcggcgtcctgccggggtcccacctcgcagaggcctcgcttcgctcgacgtcccgccccggacagccccagcaccggggacgacccgcgctgcgccagcgaaccccgcctcggaggagtccccgcccgggctctcaccgccacgcggcgcgagcccggccagcagccggcgcacctgctcggggagtggccttcggcggagacgagcctccgattggcgcggaggtgacaaaggggcgtggcagataaggccccgcccctcccaccccccaccacccccccggagtacttaagggagttggcggcgctgctgcattcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccaggtgcgttggaggggttctgggctccaggaggtttgggggagacaggcgaaggctgcgtggggggcacctgagggaggcggcctgcctgagccaggatcgagtcacaggatgttttgtggaccattgcgggctcgggagaccgggcaagtgggtccccagttccggggatctgtctgggtggttgggggagtgccgtgtagagggcaggggtcttcagcttggggggcctttgtagccggcgagaggcggaggagctccgcaagaggggaaggagaggaggcctgtgtcaggagggccctctggacgctgctggggagagtccggagtccagagggttgaggggaggggtggggagacgagatgtgtgtgaggagggggattggggcagggtggtggctccggggctgggatgatggggttctggcctcaggctggagactggggacttaggagagggagatcaggaaatgacctccttcaactgggggtcctacgtgtgagagactcagattgggtgacctgggcgaggagggcaggaacctggtctgtcctgtggataatttttttgatctaattatgtattgagaatcggccccacccagcccctggccagcggtgggctcatgtttgttgattgagtgaatgatttaattaacgcctgactctgctttttctccctcagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccctccctagccagacaggatgttgtcagaccccccgcctggctctgaatccttctttgagaactttctcaaaacttaggctgatgtttctcttctgtgagcctcattttctctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactgaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttattggcatcttattcgactaaggctacccatttctcttccttcgtgcaccaattgctctgattttaacatgtaaaggtccaactgcctggcctcctgggtgcctgcccagctcacagggctctattttgggacagttgaacccctcagggtgctgcagtcctgcctgcctctctcacctcccatctggacattattttaatgtaaaggcatggctgagacacagaaatccccttgaaatgtatcattgcggtcctcattgactcccattgtgtgccttaatggtgggcccagtgggtgggggctgggaggggtggagcaggtgcatggggcagcggtgcccagcacctgttccagtcacagctgctggcccactgcatggcaggcccctttaatccggggatatcgcatgtacagtgcccccctcggcgccctttgtccccgccggcctggtgccgatttcacacttgccaggagtaccatgaaggcgtctggggggcgagggatccaaggagtgggggtctgtgcctcctgcgtgtgcacacagcccccgcccccagcccatcatgtcctagaatgtctccttccccttttgtttgggttcaggtctcatcacactttgggcacttactgtacaggagggtagtgctcaggacttcaccaacagccctgggaagggaagggaggtgctgtcctaactctggtcttacaaatggactccagccccttttccagatctccagagtcagcccttagttcacaagggtgaacttacccttctcattcacatgaagacttagaatgcaatcaacaaacccttcaggcgtggcgtgtggaggctgctgagtaatggcagagtggagtagtgctcaggcacccctcccccaatcctctatgtcccccaccctttggagtggcgagtttccatttctgccccatgagactgagtccagctctcaggcgctccataagtccctattgaatgcatgggtcccattggagccatcctctggactctctcctaccctggtagctcagtgtggcaccctaggcacccaggaggtgatggaatgaattcactctcagctcttaaattccatccagcgctgggatttcacaggcgggccctgaccttgcgggcatatcagactgggcgtgaggggattggagaattgcatgttttttaaaaagactattcagtattatggaatagtgtctagcacttagtaggagctcagtagattaaaaaaaaaattatagacagggtcttgctttatcgcctaggcttgtctcaaactcctggcttcaagcaatcctgcctcactcggcctcccagagtgatgggattacaagcgtgagccaccacacccagcctcaatagatttttgtttaatgggttactgttatgaccttttatttggaaaatgctgcatcccccagaaaaaaacaaatcaacattattggtgtttttggaactatatagctttttggttggagcagggattgttatgaggcatgagtgagggggcagactcctctgaggcctctttaatttttaaaacagacttatttattctctaagggcttgttgaggatttactgggcacccagctccatgtgcaagacttttcccaacacagccttggccaggcagatggtgtgtcagggccacaggtttccgtagcctcttgggtgatagaaaggggcccaggccctgggctggggctcagaagggactcaaaggaggcccttgcccttatgggactcagcctgattggagaacagacaaggagatttgggattacagcgcaggaggtggggtggtgaggaaagcaggctgctggccgggccccaggagtggcctaaccagcttggaggtgggggtggggaagcctcttaaggctgactctggctttggcccccaacagagtaaatcaaggaatgactccaggactgatggtaaggacaccagtcacgtcctcccttgactgaaggcagtaagggcagtaggtgaaatcagaggctttggggtcctgccaggggaacctgaacatgctacttctgggcctcagtttcactgtctctgaaatgagaccacagtaggatcaagtgacagtaggatgaatcagtaaaggtgttgagtcattgttgaccacttcgcacgtccctgcgggatgtggatgagtaccctaccttctgtcacttatcaacccctatgagtggggggtgaatagccccattttacaggtgggaaaatggaggctcagagaagccagacaacttgctcagagttgcacagtgggaagcagcagagctccgtcaggtcccggcctttggaccctggctgtgtgtttgacggaggcctggctttcctgggatcatgggattctttcagggtttggggtatgcggggagggattcccatcactgccagccgttgtcccacggctcactcggcctttctggcgttctctccccaggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaagtctttggtgtcatagaggagtgggtattttgaaaggtctttggtaagggaggaggggacaggaattcctgaagcttagatatttctgacacagccttaaatcttgtccttggaaacatcatagggctttggagtcctgggtgtcactgtcagggaccttatgagactgggttttcccgttggcctgggtgtcctgtctgctgctgtttgggtgagccagcggcatccatacgagctcttcactatacactgtggctttttactttctcgttcttgaattttgaagttgatctggcccacggagtgcaaagctggcttcctgggtcttatcaactagacaggctgcaaagctctgccccagcactgcaggtcttttggggtgggattgtccgcttcccccagatgcgagtggaatgcgaccaaggagacagaggatgtccttcctgtttccaagggctccaggcccccttgggcctccttgtcagtcccacacctccgtcttgctgctgggtaccaaatggcctttgatgcgaggaaattggctggctggagccagtagggtgagaagccaggccaaagggtaggggtcactcagcttcctgctccgaggacggcgggacggtcagcatgcgtcttgggctagggtaattcattccccgccagccgatggtggtgacctcaccactgggggcctcttggggccaggagaaaatgagtgtcctttttgaacacaaaaggtgctggaggtgccagtttcctgtgaggagctgaggcgtcccagagcttcggagccccagagtcaggctgggggtggggggagcttcatgttccaaaggagagatgattctttcttctaaacaggaaatggtgacccgcaggccgggagcagcccttaatgacttgcagctttcctcccaaaaggaaaaaaaaaaacgttctctaacaatcgccaaattgtggcctgcctccctgaagggaagttagggagttggggggatgggggttgggcatccatgagctgaaggcctactgtgtcctgggtccctgcgggtccctctaggtcgtctccatccacccacagtaggtgctgaatgaatgatttcatgacttcacataatccctgggggtcgggcctccggaaaatgaggcacagaggtgggcttgcctgaggtcaccaagcccggcccctcaggtcatcctgggagttcggtaggctgggctcatgccgctgactctcagggcacctggagcaaggctctctccctctgggggccccagtttctgtgtctataaaacagggtgacagtagtgccttcctctcggagactgtacagaggcattcattcattcaggggtttcgagggtaccatatgtgccaggccctggggttacacccgtgaacaagacaggccatccctgcgttcatgggacgtatgttctggtcggggagagagaaagcaaacaagtgattaaataaacaagccgcttttctacagtgatggtgccaggacagaatgaaagggtgccaggcactagagaacaacggggtggggctccccaggccaaggcagtgagagccctggaagagctgaattccagcccggacctgaaggaggagaaagatgccggcagggaaggatctgggggagggaatagcaagcctgctggaatgtgctgcccccatgagaaagaccaggatggcggagggactgggaagacagggtgggagaggagagtgggcccagctctgcagagcttgtggtgctaagcaggtgggaattttgtctaagcccctagggcagccactggggctgtaaagcaggagagtgctgaggcctgctgttacctttcctacaaagatctccctggctgcttgggagaatggatctcaggggtccaggaggagaaagacaaaggcagggagaccatgagaaagccagagggggccaggcaccctggctcatgcctgtaatcccagcaatttgggaggcttagacaggcagatcacctgaggctaggagttcgacaccagcctggctaacatggcaaaaccccgtctctactaaaataaaaaattacccgggcatggtggggcatatgcctgtagtcccagctacttgggaagctgaggcaggagaatcgcttgaggtcgggagctgagatctcgccactgcactccagcctgggtcacagaacgagaccttgtctcaaacaaacaaacaaacaaaaaagggccagaggggagggagggaaggaaaggagggaggatggtggcctggctcagggtgttggtggccttggagatgaagcctgtatttaagaaacttgtggcagttgtggccacccagcccatggcccagcacacctgagccctagtgggtgacagttatttagtattattatctggggaactgggcatggtggttcacatctgtgtagtcctagctatttagaggctgaagtgtgagggttgctggagcccaggagtccaaggccagcctggacaacacatcgagacattgtctctacaaaaaaatttaaaaattggccgggcgaggtggctcacgcctgtaatcccagcactttgggaggccaaggtggggcagatcacttgaggccaggagttcgagaccagcctggccaacatggtgaaaccccgtctctactaaaaatacaaaaattagctgggtgtggtgtcatatgcctgtaatcccagctacttgagaggctgagcacgagaatcccttgaacttgggaggcagaggttgcagtaagccgaggtcgtgccactgcactccagcctgggctacagagtgacactctgtctcaaaaaaaaaaaaaaaaaaaaaaaaaaaaaagtccgggcttggtggagcacaccaccaaggggatgttggatctagtgggggtagatactatgaagctgagaaaagaatggggaaagcctctatattctgatcctgagcaaaccccaaagcactaagtgaaaaagaaatcaccggcagatgtgctcccttctgtgggcagaagagggatgaaaatcatcaacacgtgattcattcttgtttgtatttgcatacggagactctggaggttaggacaatatactaacaaaagtggttccctggtgggttgcaggaggtgggattggggtggacaaggactggagggagggaagaagggagccattttttaaagatttttaagacgttttactttgaaataattgcagcctgacagaaattgcaagaaacagtaaactggaatcgtacattcagattcttcaatacgttaacgttttatcatggatacatcttccctctcttcctagacatacacacacattatttagttctgaaccatttgaattttttttttttttcagatggagtctcgctgtgtcacccaggctgggatgcaatggcgtgatctcggctcactgcgacatctgcctcctgggttgaagcgattcttgtgcctcagcctccccagtggctggaattacaggcatgtgccaccatgctcggctaatttttgtatttttagtagagacggggtttcaccatattggccaggctggtctcgaacttatggcctcaagtgatctgcccgcctcagcctcccaaagtgccgggattacaggtgtgagccacggcgcccggcctgaaccatatgagagtaagttatagacacagtgcccctttactgctaaatatttaagctatgtgtcctaaggataaggacattctcccatagtttcatgatcaaaattaggaaatttaacattggtgcaatgctactctgtaatccatagtcataatcacatttctgcaagtgccccaatgatgtctttcacagcattttggggggtgtagctggtggggaatgaccaggatgcaatgcaaggatcacacactgcattcacttgtcctcactcttttatttatttatttaaaattttttttctaacagagacaaggtctcactctgttgcccaggctggtctcgaactcttgtgggttcaagcaatctgcccgcctcagcctcccaaagtgctgggattacagacatgcccagctacttgtcctgactctttttttttttttttttttttttttttgagacagagtttctctcttgttgcccaggctggagtgcaatggcatgatctcggctcactgcaccctccacctcccgggttcaagtgattctcctgcctcagcctcctgagtagctgggattacaggcatgagccaccacgcccggctaattttgtatttttagtagagatggggtttctccatgttagtcaggctggtctcgaactcccaacctcaggtgatccacccgcctcggcctcccaaagtgctgggattaacaggcgtgagccaccgctcacttaatctcttttttcccaaggcagctcctcagcctttctttgtctttcacaacattgacgttttttgaagagtacaggccagttgttttgttgaatgccctccagtttttttcctgatgtttcctcataattacatttgggatacgcactttgggcagaaccacagaagcagcatgtgtcttgtttggtgcaaggtgtcatgaagcacatgaggtcggctcatcccagactgacatcaactttgactgcttggttaaggtggggcccactaggtccctccttgctgaagttcctctttttccctttgcgctcaatctgtatcttgtgaagagatacttgaagaccatgtgatgcctccgagtatctcctcacaagatacggaaaggaccatgtgatcctatgatgcctcaaacttccatccacaagtttcatccctttcaggttctttttgcctaaatcaattacattttacgatggtagttaccaaatgatgatttcctttctttttttttttttttttttgagacagagtcttgctctgtcgcccaggctggagtgcagtggcacgatcttggctcactgcaagctctgcctcctgggttcacgccattctcctgcctcagcctcccgagtagctgggaccacaggcaccctccaccacacccagctaattttttgtagttttagtagagacggggtttcaccgtgttagccaagatggtctcgatctcctgaccttgggatccgcccgcctcggcctcccaaagtgctgggattacaggcgtgtgccactgcgcccggcccaaacggtgattttctaaccccatcattccttctactttactggctggctttctcctgcaggacttcccctctgtcggggcagcggcttagagctgtgggttgggagaaatggggccaggagcagcaggatctggccaggccattagatcctccccggggattttctttaaaacgagtccaggaaataaactggctataaagccagtctccatgcaagtgtcaaggcaggcaggtctggggccaaggccatctctgggcacatctgggctgcattagtgacctgttggctacttatgggtatcctctgagctgggatgagggtctcctggtagacagggatcaggactgtccttgttcttctttgctttcaaactgtttatttttttcgtttttccttttttttttttttttttttgagacagagtgtcacccaggctggagtgcagtggctcaatctcggctcactacaggctcaacctcctgggctcaagagattctcccagctcagcctcctgagtagctgtgactaaacacacacaccatcatacctgcctaatttttgtgttttttgcagagatgtagtttcgtcatgctgcccaggctggtcttgaactcctggactcaacctatcctcccacctcagcttcccaaagtgccgggattacagtcatgagccgctacacctgcccaaattgtcagtttcataaatatcacaggaacgtattccctcctttaaaagagtgagaaggtgacatgtgaagctccagtggcatgtgatcaacactctctatccttatgcctttactgtccccagcatgacgccatggagatcttggtttacatctttgtcagttaaaaaaattagcaactggccgggcgtggtggctcacgcctataatcccagcactttgggaggccgaggtgggtggatcatgaggtcaggggttcgagaccagcctgaccaacatggtgaaacctgatctctactaaaaatacaaaaaaattagctgggcatggtggcgggtgcctgtaatcccagctactcaggaggctgaggcaggagaatagcttgaacccaggaggcggaggttgcagtgagccgagattgtgccactgcgctccagcctgggcaacagagcaagactctgtctccaaaaaaaaaaaaaaaaaagcaactatatttcttttctttctctctctctgtctcttttttttttttttttttttttttgacagagtctcactctgttgcccaggctggagtgcagtggcatgatctgatctcagctcactgcaacctctgcctcctgggttcaagtgattctcctgcctcagcctccaagtagctgggattacaggcgcccaccaccatgccccactaatttttgtatttttagtagagacggagtttcaccatgttggcaaggctggtcttgaactcctgacctcaggtgatccacctgcctcagcctcacaaagtgctgggattatagatgtgagccactgcacccagcaaaaaaaaaatgagcaaatatatttccatgcatacatggctccgtctcacttacctggttccacaagggcctccaccacctctgcctcatccctttccccgcccccctcactccttccagccacaccaggctccctgccccctcagggcctttgcactgccactccttctgccaggagcactaccctagagagccacatggccactcacctcccatccctctccctttcattccaacccctttccctgttattttctccatctgacaaaacactcatttccctgttcagagtttctctgttgactgtcttcccccaccagaatgtcagctccatgcaggtggaattttttttttttttttttttgagatggagtttcgctcttattgcccaggctggagtgcaatggcacgatctcagctcaccacaacctccgcctccagggttcaagcaatgctcccgcctcagcctcccaagtagctgagattacaggtgcacaccaccacgcatggctaatttttgtatttttagtagagacggggtttcaccatgttggttaggctggtcttgaactcctgacctcatgatccgcccgcctcggcctcccaaagtgctgggattacaggcatgagccaccatgcccagccatgcaggtggaaattttgtcttcttcattcactgtgcagtgatccctggagtccctttcacatgtgggaggcacacgctccgggaaacattgctgaaggaatgatgagtgagttgatatgtgcctgtcagaaacaccgtgtggtcaccatttttttttttttttttttttgagatgaaatctccctctgttgcctaggctggagtgcagtagtgtgatctcagctcactgcaacctccgtctaccgggttcaagcaattctcctgcctcagcctgccgagtagctgggattacaggcgcctgccatcatgccttttgttgttgttgtcgtctttttagtagagatggggtttcaccatgttggccacggtgacctcgaactcctgacctcaggtaatccacctgcctcagcctcccaaagtgctgggattacaggcgtgagccactgcgcccagcatttttttttttttttttttgaggcagagtctcactgtcacccaggctggagtgcagtggctcgatctcagctcagtgcaacctctgcctcctgggtccaaatgattctcatgtctcagcctcccaagtagctggcattacaggtgtgtgtcaccaagcccagctaattttttttgtatttttagtaggacggagtttcaccatgctggccaggctggtctcgagctcctggcctcaagtgatccgcccacctcagccttccaaagtgctgggattacaggcatgagccactgcgcctggcccattttgaatttttgtttttgagtttgtttggttagacttccttctgctgtgaaacccacagttgggtgatatattagtttcctagggctgcccccaccaaattcccatgaacttggtgggaagagcagaagtttattccttcatggtcccagaggccagaagcaggacatcaaggcatccacagggctgtgtttcctccacagactgtagggtagactccttccttgtctcttctctgtgtctttgtttctctttttttttttttcaagatggagtctcactctctcgcccaggctgctcactgcaacctctgcctcctacttcaagcgattctcctgcctcagcctacagagcagctgggattacaggcatgtgccaccacacccggctaatttttgtatttttagtagagagagggtttcaccatgttggccaggccggtcttgaactcctgacctcaggtgatctgtccgcctcggcctcccaaagtgctgggattacaggcgtgagccactgcgactggttagccgtctctgtttctcttaagacaccagtcattggatgtaggggccaccctaatccaggattatctaatctttacttgattgcatccacaaagatgctatttccagataaggtcacattcccaagtcctgggaattgacttgaacatatctctgggttctacaattcaaccccaggtgtactggtggctacaaccaaaggcttggcaaggctttctcagggtctggaatgaatccaggtgcacttatctgtttatttatttggaggtcggtggggggggggggttctcacgctgtcacccaggtggaagtgcagtggtgcaatcacagctcactgtagccttaagcagatccaggaagtttttattattcactcaccaaaccctgcaggagggtcaggaaggtggcctggaggaggggacccttaggaggagacttgggaggtgagtaggattttgcctctgtggctccaggaagagagagagagccctaggtcaaagctccaccaagccctgactgcagaggttactgcatgagcaggtaccccagggttgggtgacagccacagagggagaggtcggcttgcatcagggccaggccatgcgggcctcggagtggggaactacagatttatcctgagggcaatggggagccatgggaggggctggcagggaggggactgagtgggtttactctttggaaagatccctggggccactgtgatgggagcaggtctggcagcaggaagagcagttgaggaggtggccacggccccgtgatggtggcagatgaggcaggggtgctgtttggcgacacatgaatgagcagactgagggaggagacaaggatgatgccgggacaggatttttcgccaagtgagggaaataaggacccagggaggcaaagagcaaacactcaggcaaataataatgacgatgatggtaacagaaacacttcattccagttcactacctgttttgcacggattatttaatttaatcatcacaacagcctgaggcaatgtgggtataagagaaggtcctatagagtttaggggctctagagtcaaacttcctgggttcagtctctgctccattgcctacctcctgtgtgacctagagcaagttgttcaacctctctgagtgtccattttcttatctgacaagcagcctctccttcctggggttgttgtacagattcagtgagtaaatccttgtaaattggccggcacggtggctcacgcctgtaatcccggcattttgggaggccgaggtgggcggattacctgaggtagggagttcaagaccaacctgaccaaaatgaaggaaccccatctctactaaaaatacaaaattagctgggcgtggtggcacatgcctgtaatctcagctgttcaggaggctgaggcaggagaatcgcttgaacccaggaggcggtggttgcggtgagctgagatcgtgccattgcactctagcctgggcaacaagagagaaactctgtctcaaaaaaaaaaaaaaaagaaaaaaagaaaaaaaaaacttgtaaattgcttgccctcgggcctggaagagtaagctttagtaaacagtggctgtaactatgcccattttacggatatgaagaaagggagagtagcgaagctttccaagttcatctagaggataatcctacggtttcaggcactctgcgtctcttaccaaagtctggggacctgagctggcctgcagatcccagggtctggcatcctgtttcatcccctggaatcctgagtgccagggctgggcagcccagacctggaggagccgggacacttgccgtgcacacttcctctctgggtacaacctggaaggtcctcaggctaggggacgcagggcaccaaactcaattctatttagctggagctatggcctgaaataaaagcttaaatggggctgaaaaggtagcagcaaggagaaatgaaacccatgtgtcactcatgggggccctcgggacggggatccctcagagaaactcatctttaccccagggaaagacccagcgctgggcacggggctttcccaaggctgtcaatcttctgcttgcagttacaaatgccaccaatgtctcactttgtgacccaggatgagtccttgccttctccagcttcactttgcaggtcaccaaaatgtgcttaacttttgacccaataataaaataaaaagcactttaacacacacattttacccagcacgtttcagtagagcaaacaccatcaacaatctacatgcccagcacaagtggattgtatatgttacctggagtcctggtgtgttctgaaaactttgcaattatagatgattatacaatccctaaaatatacatggtatgtatatttttctctattttttttttttttttttttttggagacagggtcttgcgctgtcatgcaggacggagtgcaatggtgagatctcggctcaccgcaaccttgacctctcgggctcaagtgaccttcccatctcagcctccttagtagctgcgactacaggtgcatgccaccacgcctcactaatttttgcattattattattattttttttttgtagagacggggtcttgccacattgcccaggctggtctcaaactcctgagctcaagtgatcctcccacctcagcctcccaaagtgctgggattacaggcataagccaccatgcccggcccattatatgtatctcatatgaacagagaaagaataagcctggcacatgattagcagcccaaaatgcttttttttcttcttctcgagatggagtctctctctgtcacccaggctggagtgcaatggcgcaatcttggctcactgcaatctccacctcccaggttcaagcaattctcctgcctcagcttcccgagtagctgggattacaagcatgcaccaccacatccagctaatttttaggttttgtttttttgtttgtttgttttttgagctggaatcttgctctgttgcccaggctagagtgcaatggtacagtctgacctcaccacaaccttcacctccggggttcaagcgattctcctgcctcagcctccccagtagctgggactacaggcacacgccaccacgcctgggtaatttttgtatttttagtagagatggggtttcactatgttggccaggctggcctcgaactcctgacctcgtgatccacctgccttggtttcccaaagtgctgggattgcaggcatgagccacagtgcccggccccaaaatgtttcttgaacaattaaatgaatgaacgaataagcggtcagtactcagtgaatatttgttgacagaaaggaaaggagaaaaagaaaggaaaaaaggaaggatctggaaggtttgtacccacagtcacagtgattttctgggagaggaggctgaggcaatggcgaggaggagggcatttcctgttaggtaatgtttaacctcttctgcgtctgtattatgatagcttcccctaagggagcatcttttagttcacaagcaagcagtcaatagtcccacggacaaactcgattgtcacacattgccttgagaaggtgctgacaggcagaaaaagcagtttgccaagcagcctgaaaaaatgatatggccccatttcttttcttttctttttttttttttttttgagagagtctcactccgtcacccaggctggagtgcagtggcacgatctcagctcactgcaacctccgccttctgggttcaagcaattctcccaccttagcctcccaagtagctggacctacaggtgcatgccactacacctggctaatgtttggtagagatgaggtttcaccatggtgctcagctggtcttgaactcctgagctcaggcgatccacatacctcagcttcccaaagtgtgggattgcaggcgtgagccactgcgcttggccaaggccccatttctgtaaaattttacctctagctttacccatccttgccttcacacagagggaagcgcctgtctgccctgggggtcaacagtggttctgtctggatagtggggtggctggggttaagttttcttttttataggtctctgaatttctgtaatgagcatgcaccaggcatgggttttgggtttttacaggctcacacctttaactccagcactttgggaggctcaggcaggaggatcccttaaggctaggagttcaaggccagcctgggcaacataatgggaccccacctctacaaaaagtagtaacagtaaggagtatgtatttttctttttaaacagaaacacacacacacaggaaaaacatgcaacacttggcaatgttccgggacctagggggtctggcactctgcagtcatggccaccctgtcaatcttgagggccatagagtgacatttgggtgccctgtggtgcccaccctgagcactgccagtgaactgaatccatcctccacctcagtatctatggacagctcattcttcaactctggggggccgatattcaccaagaccacgaatattcacccagaccacgaatcttcaccaagaccacaaatcttcaccttgcaggtgctcactgctgtgactcaatcattccagggaatgagctgcatggggtgacagccccttcgagagagtcagggactgagctcagaaaagacaaaggacttgtccaagaatgcacagccattaggtaagtggtggcaccaggtttttttttttctttctttttttttttttcttgagatggagtttcgctcttgtcgcccaggctggagtacagtggcgcgatcttggctcaccacaacctccgcctcctgggtgcaagtgattctcctgcctcagcctctcgagtagctaggattataggcatgcgccatcacgcctggctaatttttgtatttttagtagagacagggtttctcaggccgggtgcagtggctcacacctgtaatcccagcactttgggaggctgagacaggaggatcacgtgaggtcgggagtttgagaccagcctgaccaacatggaaaaccctgtctctactaaaaatacaaaattacccaggcgtggtggcgcatgcctgtaatcccagctacttgggaggctgaggcagaatagcttgaacccaggaggcagaggttgtggtgagctgagatcgcgccattgcactctagcctgggcaacaagagagagactctgtctcgaaaataataacaataataataaaaagagacagggtttctccatgttggtcaggttggtctcgaactcctgacctcaggtgacctgtccgcctcggcctcccaaagtgctgggattacaggcgtgagccactgcgcctggctggtacctggattttttttttttttttttgaaatagagtctcactctgtcacccaggatgaagtgcagtggtgcgatctctgctcactgcaacctccacctcccgggttcaagtgattctcctgcctcagcctcccaagtagctgggactacaggcaagtaccactacgaccggttaattttttttttttttgtatttttaatagagacggagtttcaccgtgttagccaggctggtctcaatcgcctgacctcatgatccacccacctcggcctcccaaagtgctgggattttaagcatgagccaccacacccggccctgcaccaggattttaaaaaatggctgtattgagatataactcacatgccacacaattgatctacttaaaggctacatccacttaaaggatattcagcaggctttagtatcttcacgaggttgtgcaaccatcatccctatctaattctagaacattgcatcacctgaagaggaaaccccatagccatgagcagtcactccccatttcctcctcctctcagctcctggcaacaactaatcagctttctgtctctatggctttgcctatcctagacatttcatagaaatggcatcatagtaatggatcatacaagtcatcacgtggtctttagtgtctggcttctctcacgtagcataatgtttttgaggttcatccatgttgcagtgcataacagaacttcattatttttgtgtctggatgaatacagcacattctatttgttcattcatcaactgacggacatttgggttcataaatggaaacactttggggctattatgaagaatgcagctgtgaacattcctgtccaggtttgtgtgtggactacgagcaacatttgagagagctgaagttgttctgcatccttgtcagcacttgtcattatcagttttatttatttatttatttatttatttgagatgaaatctgactctttcactcaggctggagtgcaatggtgtgacctcggctgactacaacgtctgtctcctgggttcaagcgattctcccacctcagcctcccaagtggctgggattacaggcacgtgccaccactcctggctaatttttgtatttttagtagagacggggtttcgccatgttggccaagctggtctcaaactcctgacctcaggcgatccacccacctcggcctcccaaagtgctgggattacaggcatgagacaccccacccagcccagttttaatgttttgttttgtttttgttttttggggacgaggtctcactctgtcacccaggctgaagtgcagtggcatgatcatagctcactgcagactcgacctcctgggctcaaatgatcctcccacctcatcctcctgagtagctgggaccacaggtgtgcaccaccatgcctgggtaattttttaattttttgtaaagatgagggtcttgctatgctgcccaggctggtttcaatcccctgggctcaagtgagcctcccacctcagcctcccaaagtgctgggattacagggatgagtcatcacacccggcctgtttttatcttttattttagccattttagtagctgtgtgtgcgtaacagttttcgcaagatgtaattgacaaatagtaaagtgccatatataaagtacaaaatttgataactttttctttctcttgggaaataaaggagtggcatttctgggtcacgtagtaactctctttaggcaccaaaatttgaatgggatctgtcctgtggcagggctagggtcacttctgctggcagagtccaccgccttgggaaggagaagctgagccctggctctcatcccgactcttttctctgggaagggggcaagtctgcagaaggttcaaggatccagctctgagcccctgcaatcatagctcagtccttcctgcattcaccacatgtgcactcagtcctaaggtcaccaggccaggagtaacacaacagggaacagacaagtccctgttctcaggatgctgacaactcaccttggcttgagaaggacacagccttgggccaggcgcagtggctcacacctgtaatgccagcattttgagaggccaaggcgggtggatcatgaggtcaggggatcaagaccagcctggccaacatggtgaaaccctgtctctactaaaaatagaaaaattagccaggcgtagtggcgtgtgcctgtagtcccagctactcgggaggctgaggcaggagaatcgcttgaacccgggaggcagaggttgcagtgagccgagatcaggccactgtactccagcctgggtgacagagcgagactctgtcttaaaaaaatatatattgtgctgtttgagaaggatacagtctgtctggggtcctggctgaggcaaagcaactggttctggagcccaggaataggttcttcctgcagccctccagagaagcacagagctgttactatcatacccccattcagacagatgaggaggcccaagtcccagaggaaggagggatttgcccaaggtcattccaggtgataatggctgagcagggattcgaacccatttctcagggaagggagtgatgttgcctgggaagagtgcagggtgctatgggagagccacggggggcacgagcttagtcagggacttggggatattaggcggagccttcccagagatggaagaagtaggagttacccaggcaaagataactggaagagggggaggaagttgcaggcagagagcatgacaagtgccaaggccctggggtggggaaatgtttggggtattgaagaaatggcaagaggtcagtgtggctgggggagagaggtaggaggaaggcgggcaggggctggcatcccctaggcctcataggccacagccaaaggccaggcatttggattttattctaagctgtgggaagccaccaggggattttatgcggaggagtgacttccctctggctgcgtgtgggaaataggctgtggggactgaaggaagtgggaggccggggaggaggcacctgcagcttgtggctttccctggcaggtcagagaggaagaaggggtgggagctgtctttgtggatgggctgggtggggttggagagtgagtgaatgcaaggaccaggctggaggagggttgcagccctcatgaaagggtggggggatggtggcaccaagactgggtgcccaggggaagagacagggaggaaaacgtagaaatgcatttttcttctttttttttttttgagacggagtctcgctctgtagcccaggctggagtgcaatggcacgatcacagctcactgcaacctctgcctcctgggttcaagtgactctcctgcctcagcctccagagtagccgagattacaggcgcccgccaccttgaccagctaatttttgtattttagtagagacaaggtttcaccatgttggccaggctggtctcgaacttctgacctcaggtgatccacccacctcagcctctcaaagtggtgggattacaggcgtgagtcactgcgtccagctgcatttcttttttttttttcttttttttgagacagagtttcgctctgttgcccaggctggagtgcagtgacacaatctcagctgagtgcaacctctacctcccgggttcaggcgattctcctgactcagcctcccaagtagctgggatgacagatgtgccccaccctacccagctaatttttatatttttggtagagacaggggctggtcttgaactccttacctcaagtgatccacccaccttggcctcccaaagtgctgggattacaggtgtgagccactgtgtccagcaaaggctttttagaaaaataaaaacataaaggcccaagggacaagaaagaattcctctaagtacagggtcttccacaatctatctatctatctatctatctatctatctatctatctatctattttttttttttttttttagaaatgggatcttaccctgttatccaggctggagtacagtggcacaatcatggctcactgcagcctcaaacttctgggcttaagctatcttcctgcctcagcctcctgagactacaggcatgtgccaccacccctggctaattttttaaaattgtattttagagatggggtctttgtatgttgcccaggctggtcttgaactcctagactcaagtgatcctcccacctcagcctcccaagtagctgggattataggccccagccactgtgcctggctcagagtatttttaagcataaatacagacgtgttaacacttgtgtctggtggcctctgtggaggaaacttggggtttgtttcagggcgggaaggagactgacttgttacatttttttctttcttgaactgtctggattaaaaaaaaaactttaacgaaagcatgacaatataaaagatgcaaatcagaagtgtccatccccaaaaataaaaaagaccagaagtgttcatctcaatgcctgttttcaacgtgaacccatttctgtgatcagcacctagatcaagaaacaaaacatttcagtcccacacaaattagcttctttttaattattattatttattttgatttttgatttttttagagacaggatcttgctctgttgcccaggctggggtgcagtggtgcaatcatagcttattgcagccttgaactcctgaactcaagtgattctcctgcctgagcctcccatgtagctgggactacaggcacacaccaccatacctggctaatttatttttcatagatacagggtcttgatatgttgcccaggctagtttcaaactcctgggttcaagcaatcctaccacctcaacctcccaaggggccaccacgtctggctttgataagtttttttttgtttgttttttgtttttgagacaggatctcgcttggttgcccaggctggagtgcagtggctggatcatagctcactgcagccttaacctcctgggcttaagtgatcctcccatctcagcctcccaaactgctgggattacaggcgtgagccaccgtgcccggccaagaaaaggatatttttattgcatgcatcttcacatagagatgagccaccaggaagaatcctaccaatgggtgtggaggtgggcattgttctcaaactcttcctctcttttgtccctcccttgctgccccggacagtccctgtgctcaaggataggggatcagaggtgaatcagacctgaccttgcccggtcacagcaatgtaccagcaggagagaccctggttcaactctcagcttggctactgacctgctagggggtctcttaacctcttggttcaccctcttaacctcttggagcgtcagtgccctcagctggaaaaggaacattccacagattcctggactggcagagtggttgaaagggatagaaagaaagaaagcatgagaggtacctatagtaaatgatgaaggaatgatagctaagcatggtctttccacagggcctttgtgcattctatttctgcttcttggaacactcttccaggaagatgctttaatgaggggacttccagcagcatcaccagtggcaacaggacagcagggcctggccggcagggtctagctgtccacaggactccatccctcaaaaagaccttctggccaggcatggtggctgatgcctgtaatcccagcaccttgggaggccaaggcaggagaatcgcttgagtccaggaacaaaaacaggctggattcggtggctcaagcctgtaatcccagcactttgggaagccaaggtgggtggattacttgagatcaggagttcgagaccagcctggccaacatggaaaaaccccgtctttactaaaactacaaaaattagctgggcggggtggcaggtgcctgtaatcccagctactcgggtggctagggtaggagaattgcttgaacctaggaggcggaggttgcagtgagccaagatccagccactgcactccagcctgggtgacagagcaagactccatctaaaaaaaaaaaaaaaaaaaaaaaaaagggccgagcacggtggctcacgcctgtaatcccagcactttgggaggctgaggcgggtggatcacgaggtcaggagtttaagaccaacctggccaagatggtgaaaccccaactctactaaaaatacaaaaattagctgggcgcagtggcaggcacctgtaatcccaactactcggtaggctgaggcaggagaatcgcttgaactcggggggcggagcttgcagtgagccgacatcgcgccactgcactccagcctgggcgacagagtgagactccatctcaaaaaaaaaaaaaaaaaaaattagccaggtggcgcatgcctacagtcccaactactcaggaagctgagacaggagaatggcttgagcctgggaggtggaggttgcagtcagcagagatggtgccactgcactccagcctggtgggcagagcaaaactctggctccaaaaataaaataaaataaaacgaaaaataaaagaaacaaaaacaaaataccttccctgaccatcccaggagccatttcatgcccaccaccgtcacttcccaacccccttccctgcattattccccccgccccgcccccccccgcccctgcactcactggcacctgacactttatttcaggggtttctttgccaatgtctggttccccccgatggaatgtcagccccaggagggcagggaggtttgcatctgttcactgcaatactccaagccctagagcagtgcctggcacgaagcagaggctccacaacgaagctgggctgggagcccgactcattgtaattgccccattcctcctgcacaaccttggacaacttcttccaacccctgagcctcctctaccctcctgcaaaggctcagagaaggctttgccacccaggtcgactaggagggtgccatgggttctgaagcccctccgcacccttagcagggcccagcgcaggctggctgcgatgtttgctctttgtctttacggtgtttctgaacttggagttctggaggctgcgcctgccgggccgaggagggggccctttctgcagccgcaggcggaggcccctcgcagcccgggcgcccctccaggccgcggccccggcgagacgaatgcagcacacggccgcctttatggggcccgcagacagcgcgtcgccaggctaaccctgcgtggaaaattcggaggtggaaggcgaggcgccttattgagggggccggcagcggcggcggcggcggcgagggggcggcgggggctgtgcggcccgggccggaaacgtgagccgggctgggggcggcgaccacccccgcgcattccccggccctcccgggaccaccgcgcgccccggccggcaggtggaggagcaggaggcgccctcaccgtccccgccctgggaggacgccttcagggccaagctcccctggcctcgttgacctcctccgctgaataggcccttcccttttggggcggcaggactaaattgcggcctggggcccaggacacgggagcaaccagcgacaccggtcacttacggatgctgttaacacgatggtccgccccatggaccacaaattgaggctgagacactcaggagacggtggcacactcagatgccagggccgtgccccatggcctaaggggacacctgaaccacactagaaattggagcggcccctgaaagtggaggtcattaataagatcaaagttaagggcccaggacctgcaggtgcccagcccggagctgccatggtggggctggagccaccccgaggtacctctctgaacctcagttttctcatctgtcaagtgcggatgggccaggcactgtgtcagaagcccaacgaagaacagagggcaggagccactagcttcttgactcctgggtttccatcccaggcaaggcaacagacggatgcccctggcagagggacatagaaacaaaaagtcaagcccggcccagtggctcaggcctgtaatcccagcactttaggaggccgatgcaggaggattgcttaagcccaggagttcaagaccagcctgggcaacatagcgagatcctctctctacaagacatttaaaaattagctgggcatggtggcacgcatctgtagtcccagctactcgggagactgaagtggaaggattgctcgagtttgggaggttgaggctgcaatgagctgtgatcatgccactgtactccagcctgggagacagagcgagaccctgcttcaaaaaagaaagaaagagccgggcgcagtggctcacgcctataatcccaacactttgggaggccgaggtgggtggatcacctgaggtcaggagtttgagaccagcctcctcaacatggtgaaaccctgtctgtactaaaaatacaaaaaattagccgggcatggtgatgtgcacctgtaatcccagtcaccaggaggctgagacaggagaatcgcttgaacccagaaggcagaggttgcagtgagccgagatcgcgccactgcactccagcctgggcgacagagcgagattctgtctcaaaaaagaaagaaagaaagagcctggcacagtggctcacacctgtactcctagcactttgggaagccaaggcaggcagatcacaaggtcaggagttcgagaccagcctggctaatatggtgaaaccccgtctctaccaaaaatacaaaaattagccaggcatggtggcaggcacctgtagttcgagctactcgggaggctgaggcaggagaatcacttgaactcaggaggcagaggttgcagtgagccgagattgtgccactgcactccagcctgggtgatagagtgagactgtctcaaaaaaaagagagagagaggagcgaggaggggaggggagggaagggaagggaagggaagggaaaagctgcacaggttgcatatataattaacaccctgggtccttggattggaaggagagaggaggcatgagaggatgactggaggaaggggaaggcaggtgaccctccaggatatgggacttggggaaggggcaaacccctaatttcttttttttccttttcttttttatttttattttttttttttagatggagtcttggtctgttgcccaggctggagtgcagtggcacaatctcggctcactgcagcctcggcctcctgggttcaagtgattctcctgcctcagcctcccaagtagctgggactacaaggaccccccaccatgcccggttaatttttgtagttttagtagagacgggggtttcaccatgttcggccaggctgatctcgaactcgtgatctcaggtgatcctcccaccttggcatcccaaagtgttgggatcataggcatgagccatcacacctggcccaaaggaccaatttcagactcagactcagagaaggcagaagtgaagctcagggtagccaggtgttgatttttgcatttgccgttccctcttcctggaacactttcttacccctgttgtctctgcagctgtttccctcacttccgctaggctggggcttgaagatcgcctctttaaagaagctttctcagaccatgtgtctaagccctgctgccttggcccttctctttgcccctggcaaagatacttatttctttttattatcttgcatgcctttggttcacttgtttcttgtctgtctcctccacctgccagtgagctcagtgagggtgggacttcgttcacagctatagcctctgcccccaacccagcacacagtaggtgctcaagaaatgctcaagcagtgaatgaatgaatggacaaagccaggccgtggaagacaaagaaagcctcagctttctttctggtgacttggtttctggctagcagaggacaggtttcctgagttacagataagcagaaggtcaggtgaatcaacgataagggatgataaggctccaggacccaccggctgttcctgcctcctggggccccacagaggaagctcattttcagcttactgcagaacctccagcagagccggggcctgggagctgggagcctactctgactgccactgctgcggggtgagaattctcacacattgtaaacgctgccctggctcctttctggctggggcagccaggtggacctgccctgggctggacaggaggtttccaggtccccaggatggatggtgtgtgtgacggggcctcccagaccccaggatcctcttcctgggggcggggcttgggcactgggttcccacagatagaatagcttagagctcaagggtgagccagctgcctgggttcaaatcctggctcagccatttagaattgggcaagctattccagctgtactgtggtcctcactgtaaaaagctataatagtagaagtgtgtaagaatacagtacctgggcctagttcggggctctgatcagctcctgtgccatagatcccttttttattatacatttagattcatgtgtgtgtgtgtgtgtgtgtatatatatatatatatatatattttttttttttttgagacagagtctcgctctgttgcccaggctggagtgcagtggggcaatctcagctcaccacaacctccacctcccgggttcaagcaattctcctgcctcagcctcctgagtagctggaacgacaggcacgcaccaccatgcctggctaaattttagtagagatggagtttcaccatgttggccaggctagtctcaaactcctgacctcgtgatccgcccacctcagcctcccaaagtgctgggattataggcatgagccaccacgcccagccttagatttacctttataaatgaaattgtatagcattaaagtaaaacattatattaaactaaagtcattaaaatatttaatagctgaatgtttgatatggtgacagctgtgctttttggtttttgtttatttatttatttttgaaacaggcacttactctgttgcccaggctggagtgcagtggaatgattatggctcactgcagcctccaccacccaggcccaagcaatcctcccacctcagctccctgagtagctgggaccagaggcccacaccaccacacccagataattttttgtatttttggtagagacagggttcaccatgttgcccaggctggcctcaaactcctcagcctcccaaagtgctgggattacaggcgcaagccaccatgcccagccaactatggtaattttgaaatcaggaagaggacgaatgctctttctatgacactgtaaagagacatggacaaaggatttctgattgacaaagccaccgtccagctactgccactgtggtttcccacgtctgctcgtaagggaaggaaatgccaaattccagttggcggttagtgaaaatcaggacatccctttttttcccccagtccaagttcacagatccctgaattctcttcgagggccctggaggtggtggtgagtgataggatctcactggggatggtgcaggtgcccagaaggaggggagtcagatgggggctccctcaggggtttgagctggagtgctgagtgcccagtgtaggtggcctgggttggaatcggtctctgcccacactccctggagacctcggccagtggctgctggtctccaggcctcctctgaggaatggcctcctcggcctctagggttgaataaggaggaggtgggacagcgtgtggcctgtgttggcacaggggtctgggctcttgatagaggggttgggggagaggccgtcctgtgccttggagggggccccttccccatccaatggcctctccgaggtctgggcctgtgtggaagtcaccgttttgtgtttgtgtcatctgggtaagctggtgtgtctttgtgtgttggggtggatgtgtgtgtgtgtgtgcaggtgtgagtgtaggggcacatctaggaagggtgtcaggcagtgtgagtcagcgtgttgtgtgtggctgtgtgtgtgagcaggggtccgttctgagagtgcgttgtgtacgtgtgtgtcagggtttggtatggcgttcactggtgtgtgtgtgtgagttgaaagtctctggtgttagttgatgggagtgaatgtgagactgtgggtgtatttggggacgtggggggtggactgatgtgtgtgtgtgagcacacatgcagcagggttggtgggcggtgtccagtgtgtgtctgtgtgaacgtgtgtggccctgtcaccgccggctccaggcccagccacataaacttcacacccctgcgggcgggctccagcggccccgcagcagccgcgtagggcaatgggaagcagatgggccaggaaggaggccatatggggctgggggtgggggcgcattcctccctcccagggccgccaggaagccccctgcctgccggcccccccatcggggtgggagctagaactgacacagtaacaaatgtcctgtagccagcgtggagtcagcgtggagccggcatggaggcagcccccgccccacagcggggggtagagagagagagtataaatgagggggatccaggagatgccggcggggaagatgctgccctgataagccacacctgaccccacggctgtgcacccttgggcgccgcacataccccctccgggcccatttccttggcagggtggctgttggggatggaatatagggacgttccccccaccccccaccgcgccccctcgtcccctccccccctccccccgcctccgtttccagaccagggtaggaccctaactccagaaaccctggtagatgtcaacagcaacagggtaaggagctgctaacctggaacttgactgcattccggcgctggggagtggcgaagaggtgggctctggagccaggtctgcctgggttccagtccgtgctctgacacttcctgactgtgtaactatcatctggcaagtcacctcctctgtgtctcagtttcttctctgtaaagtggaggtaataataagagcacctccctccccgcaggcggtgatgaaggaagtgcttgctcatcctaggccaatcccaggttttggccaggcttggggcttcgtaaatgttagctacaagcaccagctcctgggggcttcccacacccccaggaggttgcctggacgtactttgcagaggagaccagagaggtcaggtactcgccagttcacacagggtttaaggggcagagatgggttcaaacccaggccttccatccccggcgcctgctctcctcaccactcctcagggagcatggctggcgcctcccttcccaccctctccagctccgcccctgccctgtctagggtgagctgctgggctgtttcttgtcacatccagatgagagcagaggctggggccctcttccagctgagacaaggtccaggaggtcgctggaaaggcggcaggctcctcccactgtaaccctggccccgacggtgggagccagccctgactttcaggccctaattagatttaggcagctctgggtgcagaccctggctcccctctccctgctgtgtgacccagggcaagggcctggagcactcagagcctcaggggtatccggggacagggtagcagggactcagccatggggaaacggcagcgactgttcttgcagcgagtgtctgatgaacggcccctattagttcccccctcgtggaggtcgagatcaggcagggccggagtggagggaagggcttagaagcagagcttgctctgggtggctttggcctggtctgttcacctcctccaaggctccctttcctgtttcccaaagcaacatcatcaggcaggtttgtcgggaggcttaacaggatcatgtgaaagcacttggcacatgctaggtgctcaaccagtgctgtgttggcttctctgtctctctctctctctttctctctctctctctttttttttttttttttaattgagacagggtctcacactgtcacccaggctggagtgcaatggtgtgatcatagcttactgcaacccccacctcccaggttcaagggatcctcctgcctcagtctcctgagtagctgagattacaggcatgggccaccacgcccagctaatttttgtatttttattttattttattttttggagacagagtctcgctctgtcgctcaaggtggagtatagtggcaaaatctcagctcactgcaacctccacctccctggttcaagcaattctcctgcctcagcctcccaagtagctgggactacaggcacccgccaccatgcttggctaatttttgtatttttagtagagacggggtttcgccatgttgtccaggctggtctggaactcctgacctcaagcgatccacccaccgccacctccgaaagtcctgagattacaggcctgagccaccgtgcccagccagtggcttctctcctattcttgtcccttgtgggcccttgtagggacatctgttttaagttcccacccagcatggactctcctttctctgtgcctcagtccaagggttttgggtggggcatgcactcagtactgaccaatcaggacaactgcatcctctcagccaatgagagacaggcctgggatttttgctggacccatggggaaagaggcacttcgtttctattggggttgctaaatgggctgggtggaatcctggacttgggggttcatcctgccttgttgaggagaggcttggctgagtggaggctgcaaagatggagaggaggcaagtcccacggatgaaatgtgaatgcccagatgcaatcatgcctgggactgttgttgattcctgctttgtgggagagaaactgaggccaaatccaaggtcacagagccaggaagggggcagaactgggatttgaacccaggccgactggcgccagtggctgtgtccttaacctccagactctacagaggcctttggtataaatccctccctgtagcctgaaatcctcacccagcctagtttttgagctcagctatttctgagcttcccaagggagaatgttttctgcctctggcagaaaaatcgggagaaaatgaaagccctgtggtctggctgcaaactcaatttgggcaagcttgggacaaatgaaaattctttccttctttcgttcttcctctttctctctttctcctctttctttctttctccccctccctacctcctcctttccttcctctcttcctccatccatcccttccttcctctctcttccttcccttctccctccttccttccctccctccctccctccattcctactccttccctctatccttcctcctaaccccttcctcactctccttcctgtctgaaataaaccagagcttactccagcccatctcacatcctggtcctgctctcacctctgcctggatgacttgcatctctgcccagttccaagcctagttggccatgttgggccccagtacagccatcaccagtgacacctattaaaatgcagatccctggcagggcgcagtggcacatgtctgtaaccccagaactttgggaggctgaggcggatggatcacctgaggtcaggagtttgagactagcctggccaacatggtgaaaccccatctctatgagaaatacaaaaaattagccgggtgtggtggcacattcctgtgatcccagctacttgggaggctgaggcaggagaattgcttgaatccaggaggcaaaggttgcagtgagccaagattgtgccattgcactccagcctgggcaacaagagcgaaactccgtctcaaaaaaaataaataaaatgcagatcctggggccccacaccagcagatgcatatttgtgcgtttggggcaaaggcagaggagatgaacacccagtggacattcagatgcaggtggttcttgggacactgggtgtctagggtcttgtagggcctggaagaccaaggttaaaggttgtgcttaggggccagccatgatggttcatgtctgtaatcccagcactttgggaggtcaaggcgggtggatcacctgaggtcaggagttcaagaccagcctggccaatatagtaaaatcccatctctactaaaaatacaaaaaattagcctggcgtggtggcagatctctgtaatcccagctactcgagaggctgaggcaggagaattatttgaactcgggaggctgaggcaggagaattgcttgaacctgggaggcggaggttgcagtgagccaaggttgtgccactgcactccaccctgggcaacaagagcaaaacttcatctcagaaaataaaagaaactgagtttcagagtggtcaagcttcttgcccgagaccacacagctggtgggtggcagagctgggacttgaacccaggcatctggctccagactctgtgctcttactggtactgtaggaagctttagttttgcttattttattcactgctgcatctccagtgcctgccttgtgctgggtcttaataaagatttgttgaatgaatgaatggatggatggatgaatagattgctcattgaagggagttgactcaattagtaggtgttctgcaattgctctttctctcctaaatatgttgtctaggctggtctcgagctcctgacctcaagccatccacccacctcgacctcccagagtgctgggattacaggcgtgagccaccgtgcctggccgggagatcttagagcagtgctaatcctgtagcagagtcctggccttctctttccactctgtgtagcagggatagtagcaatcccactgctcagggctgtcatgacttaagtgagacagtgccagggctgtgcccagcacaggagtatatgctccatgagccgtaacaggtttgatcagtttcccaggctcttctttactctgatttccttgtctgatcctatctccctctcaggccaaacagggccacacatggtgccaggcacacagtagttgctcagggaagaaggatagctacatgagcgcttgctgtgcgctaggctctttttaaacactcatgatctgatctacttcttccaacagccaacaaggaatggacccagtgtttggcccagcagaccctccataaatgtttgttgagtgactgaatgaaacagcgctggctacattggcagagtgcctggcacaagctctgccagcctcctacctgctgccagctcacagacaggcctgggtttctacatctgccagcgctgccaggagatgaactggccttgggggaggtagttcccggctgtggagcccgagggagcaaagctgcaaaggaggattttcctccacgcagttcagcctgggctgagtaattgctcactgggtcttggtccagcggcggccagggcaggtaggcatggggctgcaggagtcaccagttgatagccaagcctggagttctgccagccacagctctagggcccctggatgacagcagcatcccggagatgccaccatgagctcagaggggtcccatcacttctctgagcctcagtctcttggttggcagttgccccagctccatggggctgtgtgagatttgaaggggtcctgtatgtgaggctgggacaggtgttatgattgtgtggagggcagaagctgcctggaagtgtgaaaaggcctcgacctcagatgcagacaggcctggagggccttgggtgagtcatttccctctgcaagcctcggcttcctccagcctgctgtcatgagccaaagaaaggagaaagatggttctcaaaagcaggaacttttgaaccataagtgagaaaagagtaataaccgtagtaataatgcctataaaaaagggctttcaatcactcattcatttgtttttgtttttcttgttgttgtttttgtgagacagagtctcactctgtcacccaggctggagcacagtggcgcaatcttggctcactgcaacttccgcctcctgggttcaagcaattctcctgcctcagcctcccaagcagccaggactacaggcatgcaccaccacacccgctaatttttgtatttttagtagagatgggctttcaccatgttggccaggctggtctcaaactcctgaactcaggtgatccgcctgcctcggccttccaaagtgccgagattacaggtgtgagccaccgcgcctggcctatgagagtccatttttatgttctccatattgtcgcttgatgctgtttctccagctgcctttttggtgtcagattcacaaagaaatattggcaatcttaaaatttacattgattcaattgattaaagtgccagaggaccaaaacatatgttagagtatttttgagttttctcatctgtcacacttctgttctttgccatatgtgagtttaattctttaatatattcactaaaatgttttgtttaatgtatcatgattttgaacttatactctctatttgggatgggataagcttctcacttgtcactgatagatccataagtctacaggatctctgaattccaacaatacttggacttatgtccctggagtggaccctgaagttctataactaggatgtggttaggccatttggaattaaatgctcttttgttttgtagaaaatattgatgtgttaactttgtatgcagtttttaaatggtttagaatattagtaacttgctttcatacatattttatgaaacaaagttcattttatagtgaagaattctttgacttgtgtggtttgggtgagaaaccagttttccttcattaaaaaaaattgttaagtttccctaaaattctatttattaaaaataaaactatcaaattttacttaaagtaaaaaaccttacatatctcaattatatggtatcagtgtccagtattttggacctagtagaccatattagagtttacaatagggaaggaaggagatactgccatttcttcaatcactcattcatttttgtattccttcagccagtacactttagcttcattcattcattcattcatttagagaacattatcgaacatttatttcctgccagactaggatagtcagatttagcaaaaacaggctgggcacagtggctcacacctgtaatcccaacagtttgggaggccgaggcgggcggatcatttgaggtcaggagtttgagaccagcctggccaacatggtgaaaccccgtctctactaaaaatacaaaaattagccaggtgccatggctcatgtctgtaatcccggcactttggaagctgaggcaggtggatcacctgaggtcaggaattcgagatcagtctcgccaacatggcggaaccccgtctctattagaaatacaaaaattagatcatgaggtcaggagatcgagaccatcctggctaacacagtgaaaccccgcctctactaaaaatacaaaaaattagccgggcgtggtggcgggcgcctgtagtcccagctactcaggaggctgaggcaggagaatggcgtgaacccgggaggcggagcttgcagtgagccaagatcgcgccactgcactccagcctgggcgacagagcaagactccgtctcaaaaaaaaaaaaaaaaaaaaaaaaaaagaaatacaaaaattagctgggcatggtggcatgtgcctgtaatcccagctactcgggagactgaggcaagagaattgctcgagcctgggaggtggaggttgcagtgagctgagatggcgccactgcactccagcctgggcgacagagcgagagtccatctcaaaacaacaacaacaacaacaacaaaagatttagcaaaaacaaaaacaagaagatctggcgaagcatagtggctcacgcctataatgtcagcattttgagaggctgaggggggcagatcacttaagcccaggagttcaagaccagcctatcagcctggggaatatggcggaactccatctctacaaaaaaaaaaaaaaaatacaaaaatttaccaggcgtggtgatttgtagctgtagttccagctactcgggaggctgagattggaggatcgcttgagcctagaagatggaggctgcagtgagccatgattgcgccattgtattccagcctgggtaacagagcaagatccagtgtcaaaacaaaacaaaacccaacaagatcaacaacaacaaaccccagaatgcctagttaaatttgaatttcagataaacaacaaacacttttttggtagaactatgtcccatactctatctcttagtgcaagtgtgtcctatgcaacacttgggcaagcccgtgggaggtgttttgcccgtgcaaccccatttcttgctcacatagccctgagaggcgagaattattgcccgtgaggaaatggaggctcagagaagtgtgtccttctgctcaggctcatgtggacgggcattctggctgagctgggggcttcggtagagtcccagtgtcatgggcactctgtcacccctgctcacttcctggatggcagtttcgggaacagagagcccgtcttggcagccacctgacactttcccctgccccagccctcacctgttggggaaagtccctatgggtcacccacaactggaggctggtgtagccaggatgcaggctagggagtggagtgggcagaaatcctaagctgtgcggcggagggggcatcagagggaaggagataggtggggcagtggtccccaaacctactttggccacatagcttcctgcctgccccacagcccctggtcaataatcggccttgctgacactccaggtggggcctgggcagagagagggcccctggagtcacccctctccccacctgtgtgtcgttgggggaagtcttggcccccctcagggcctgagcctccacctgtctacaaagaagcattcattcattcacttattcacacatttattcactcatgtatttgtgctttacttctatagatatttcttgagcacctgttacgtgttgggttctaggcatgaggcacagggatatgccagaaaatgagacagactgaaagcctcgctctcatagagcgaggtctatggtctgatgggggagacagatcatagagacataaggaagataattgtgggtgggaaaagtgctaagatggaaacaaggcaggggaaggtgatggagtgtgactgagaccgggcagtctgggagggcatccctgaggaggtgatatttgagcagagacccagatggtaagaaggagcctggctgggcgtggtggctcatgcttgtaaccccagcactttgggaggctggggtgggcagattatgaggtcaggatttcaagaccagcctggccaacacagtgaaaccccgtctctactaaaaatacaaaaattagctgggcgtggtggcaggcgcctgtaatcccagttactcaggaggctgaggcaggagaatcgcatgaacccaggaggcagaagttgcaatgagctgagactgtgccactgcactccaacctggcgacagagcgagactccatctcaaaaaaaaaaaagagaaggagcctgtccaggggatgcgtagaaagggagcctggtggggctgaggtgggagaggggggtgggggtgcatcacctggagcttcgaaggtcgcagttagagatccacttggctcctcctttgctttgttcagactctgtgtcacctcctctgaggagccttccctgatgaccctggctaaaccaggcccttctttaccccttacccttatctgtagatggcatcatagtatctgtttattgggtgtgtggggatatcttgtctttcttcctccacagttacaaggccagctgggtagagttatcatgagatgcctattgactcccccgtggtgcagaaaatgtggccacaaggatcccagcatgggtgctgttgatggatggcagggaaaatcagtgccgtgttttatggattgcagttttgactcaacttaagcctcagaagccaactctggaacccaagccttgagccccaaaagattcccccaaaatcacagtgacaatcatggctttcactggatgcttgctgcatggcacgcactgctacgcaacctttcaacatgtgcgattcactggtatttagtacatgtgcagtattgtgcaaccactgcctagatccagaacatttccaccaccccgaaaggaaaccctggactcacgagccatcacttcccatccctccaacaccccagcccctagaaaccactcacttagtttccatctgtgtgaatttgcctttccatattaatggaatcatgtactatgtggcctttcacatgttcacccatgctgtagtgcatatatggtatgtagcatgtaggtacacattttatttctgcatcagttgatggccatttcagtttcggttgcctccactttctggctatcatgaatagtgctgcaatgaacatctgtgtacgagttttttgttggtttattttgagacggagtctcgctctgttgcccaggctggagtggggtggcgggatcttggctcactgcaacctctgcctcccaagttcaagcgattcttgtgcctcaccctcctgagtagctggtactacaggtgtgcgccaccatgcctggctaattttaatacaaaaaataatttttgtatttttaatagagacggggcttcacgatgttggccaggctggtctcaaactcctgacctcaagttgatccacctgcctcggcctcccaaagtgccaggattacaggcgtgacccactgtgcccggcctgtgtataagtttttgtttgaatatctatcttcagttctttggagatatacccaggagtggaattactggatcatatggtaattctgtttaatttattgaggaactaccacctaagcacttcaaatatataaatagagatgggatctcactatgttgctcaggctggtcttgaacgcctgggctcaagcgatcttccttccgtctcagccttcaaagtgttgggattgcaggtgtgaaccattgtgctcagctgacctaagcaccttttaaagcactcatgatcctggggaacgctcacaacaaggcaatgagggaggctctgtgctgcccccattctgcagatgaggaaactgaggctcagaaagcagaattcatgagccaaggttacactggtgagaaatgatgatgtcaggcctgttggattccaaaccaacttgaacctaaagctgagaaggaagagtgtgagaaaaaagagagattatgagagcagtaacaagggtgacttcggtccacacttagcctcttgagttgccatctgtggaaaaggtgaggaaagaggtaaaagtcagtgtttctctatcaaacttgcatggattcccaccccctcctgctccgtcctggctgagtgaggttgggcaagctggttcacctctctgtgcctcagtttccccagtgaatggtgctaaggagaaaaactccctcaaatggtgaggataagaatgaaataaggccaggcgtggtggctcatgcctgtaatcccagcactttgggaggccgaggcggatggatcacttgaggtcaggagttcaaggcgagcctggccaacatgatgaaactctgtctctactaaaaatacaaaaattagctgggcatggtggcaggtacctgtaatcccagctacttgggaggctgagacaggagaatcacttgaacctggaggcggaggttgcagtgagccaagatcatagccgctgcactccagccggagaggcagagcaagactctacctcaaaaaaaaaaaaaaaaaaaaaaaatttaataaggctggcctgctgctatggttatcaatgttgttattatccttttctacacaagggtccccccagccccagaatcccatgctcttgtttcgggtgcagctctggggcaaaagggagtcagggacccccagaatcttctccccagggttggaaatgttgggtggcccagaagtagaagtagtgtctacttcaaaagtcccatgtccatgctacaactgaatgttccagatcagaaaacagcacatagttttccagaaatgctgggaccttatctcctcaggagtgagagtagcctggacccattaattcaccagaaacacattgtattttaggccagaaacaataataactgtggcctgttaagtggatgtcagagaataaaaatctaatctgaatttgtaactctgtcagaaggaatggggtgaccgagaattccacaggcgagttttcaacatggacacagggtggggggtccctgagcctctctgctgaggttttgcacagatcagggcttgtggagaacaatggggacattctttgagcacttgctgtgtgccaaggcacaaaacaaccctgggaggctgtactgttagaagttccgttgttcagatgggaaactgaggcccagagaggtggagacggttgcccagagttgaacagctaagaagcggctgagatggggcttgaacccagacagtcaggatctgactggagcccaaactctgaaccacgtgtgtctttctcagggaagtctggaaaaatgtggtttagtgttctgcacaatgaagtaacttgttcaactgaggtcactggctgatggtgggagtcactgatggaggaaatggggagagggcccaggaccccccaggaagtgtcccctgtctcctttgctgggtattttccttccctgactcttggcctgtttctttcttggtgagtgtatgtggggtggggttagtgagaaagggagaccccagctctggcgttgcgggagtgttaggatccaaggccaggcctgcagccctgggtccctcctgcctgggaggtacctggggaagtctgcagcctgtctacactggtgaagcctcagccccaaccagccccctgccctgcacttgccaactgggcaccgccactgtcggcaccacatccccagggtgtgtaacaagtgtcacagcctcacccagcctcagtttcctcccctggaaaatggggatagccacgacacgtggtggggaaggttatatttacatgacctgggctgttactcttattcctgcctccagtaagaagccacgtggagtgtctgccatgctgaggagagggcacccctggccggagcccagctggatgtcaggcctgaggctggatgtcaggccaaagctggctccagcccagcagcctgacacgaaggggagggaggcctgagtcggccagactcctgagtcactgtttcccggctctgccaggccaggcgggaaaagggggagcggggcggagggaggggaaggggataatctgggggagggagggagtggagagtgagacaccagttgtaaccattgttgggtgggacagacagaaagccacctgccaggggggcaaggagattctggggtgtcagagtggggtccttgcacttccctgcattataggctgcaaactcctccctccctcgccaccaacacatacacacacacacacacacacacacacacacacacacacacacacactgcactcagcttcacagctttccttctctttcttgagtgtgttgaccaggttccagcctcagggcctttgcactggctgtgttttctgcctggaacacttcaaggttctttctcaaatctcaggcttcagcttaaatgtcacctcttcagtgaagctgtccaggctggagtgcagtggtgccatcatggctcactgcagccccaacctccccgggctctggtgatcctcccacgtcagcccctcgagtagctgggaccgcaggcgtgcaccatcatgccctgctaatttttgtatttttctgtagagatggggttttgctgtgttgcccaggctggtctcgaactcctgagctcaagtgatccaccagccttggcctcccaaagtgctgcgattgcaagcctgagccaccacactggggcctgcctgagctttctttttcttgagacagagtctcgctttgtcgcccaggccagagtgcagtggtgcaatctcggctcactacaagctccgcctcccaggttcaccacccgggttcacaccattctcctgtctcagcctcccaagtagctgggactataggcacccgccaccatgcccggctaattttttgtatttttttagtagagacggggtttcactgtgttagccaggatggtctccatctcctgacctcgtgatccgcccgcctcagcctcccaaaatgctgggattacaggcgtgagccaccacgcccggcacctgcctgagctttaagtgtgctcttcctactccccctcccaattcctttagttcatccattcattcatttatttgcccggaaggtattgcgcacctccttcgggcagggccctgctttaaacagtgaacagagtagacaacctgcctgccctcatggagccatcactccacccaaggagatggcacaatgagcacaccgcacactgggctggaacaggtgtctctggaggagccaggcacaggtgggggagccaggcgcagctgggggagtcaggacatagcgcgggggctttccctgttggagggggttgagtacggtgtctcagaaagtgatgccagggagatctgcaggacgaatcgaaggaagccatgtgggtgtctgcggagagagagttccaggcagagggaacagccagtgtgaaggccctgaggcaggggtgtggtgggcagagtcaaggagcaggcaggaggccagtcgggtgggagcagagtgggcgaggccaggaggtgaggccagcaaggggacggggcgggcaggtggggcaggcaatgaggaggatgtggcttttgccttgagcccctggagggtcctgagcagaggggctgcagagacatggtcaagttccaggtggggttagggcgagaactgaccttccaggcagacaggcagggtccccccaccttgcccctgccctgagatgaagcgccagccttggatcaggaccctgtccagaggtgggccagggctctcaagccagactcgagtctgcactgggtagggacagcttcccacggccagccttccccgtggaggattgcttgcgggggaggggtcccctaagtctcttctctttctccctctctttcgtaaccatcagcctagccagacctttggtcaggcctggtggagagagtgttctctgtcatcatctggccatgggaaaggtgaagtaaaagccaccagtgacggagagaagcagcctgtggccagcccagcaccaccctcaccccacgcacccgtaggctgagtgcctcatcccttggccatggtcccccaacctccaacataatcaggcccgtgggagcctggccagaactgtggccagtgactcagcaggaatcaccccagacaggagccagagccccggtgtccagaccagaaaccacccctgacctgttcggctgggcaggaacagggacagagcaggcggaaaagctctcagcccaggatagccgggggagaggggcgtgggaagacccctgtccagatgcagttcgtggccacccaccctgatggtgtctgctgaggtccagatcgtagttttaggagggggttcgtggctgttctgcccaattctgttgaagccctgagcatcagcctggctttgatgggttatactgggctgttgtggtgtagcttgtctattccattgcattgtttctgttctattgtgtgttctggtctgttctagaacctaccaatcctttctattctattgtgtttattcattcagcagatacttactgaccacccctgtgtgccaggcagtcttccagatgctcgggtcacaactttgtttatttatttatttatttatttattttgtgacggaatctcactcactctgttgcctaggctggagtgcagtggcgcgatctcggctcactgcatggagttacaactttggatgaaatgagacctctgccccagggcgttcatggggagaccagcaactgataaatatcaggtagtggtaagagctgagaacagcagcagcagcatcaaagcagagagccacagaaggagcgaggcgcaggctgcgttcacagtgcggggagcagggtcaggagcagccgcagcctcactggcaagatgacagtctttttttttttttttttttttgagatggagtctcactctgtcacccaggctgcagtgcagtgttgcaatctcggctcactgcaacctctgcctcccgagttcaagtgattctcctgcttcagcctccggagtagctgggattacaggtgcgtgccaccacacccggttaatttttgtatttttagtagagatggggtttcaccatgttggccaggctggtcttgaactcctgaccttaagtgatccacccgcctcggcctcccaaagtgctgggattacagatgtgagccaccgcagccagccaagatgacagtcttgagcagagtcgggaaggagctgagggagggaggcacacagatatcaaggggtcaagaaaagcattctaggcagagagaacagcaagtacaaaggcctgaggctggaatgtgcctagtgtgttccaggactggccaggaggccagtgtggcagccaaggggagcagtagggaagatggggtgtgtggggacatggcttggaggaggttaaagccaggtgggagagagcaagagggacagagctctccacggtcctcctggggtgtggggccagctggatggccttggatagggggtacgcgtgtgagtgtgtgtctgtgatgtggacagatgcatgtgggtccgcgtgtggtgttgtgcatccctgtgtgtctgtgtgcgcccatccatgcacctgcattatgtgtctctgattcaggcagttagtgcttctgtatttgtaggtgcctgtgggtatctgcagtgtattgtgggtgtgtgttgtgtgtctggaatttggtgtgactgtataggagcaggtctgtgtgtgtcacgtctttttttggcaggtgcctggacgtgtgtgtggagtgttgtttgtctgccatgtattttgtgcatgtgtgggggtgtgtgtgtgcattagtctatgttcctgtgattgtggcatggtgacaagttttggggttcctgggggtgcaaaggcatgggaaggagccttcctgcagacccaccccaggccagcagcagcccctccccatggcagcagatacacactcactctgatgccccgggaggaggctgggcaagcagccccagagcagcaggcagcatcaggtggagaatgagggtgggagctcagttcagccaccttttctaggcatttcagggcctgtcagaagctcccatggaagatgtggaggttggggagcagtagacattcacaggcctgggaatgggggtgcttgagtatctggggcacccacgggaaactctggcctccttgggcttaatgggtggagccgggtttttgcacacacgtggtgggggcgactacatgtactgagctcatgccagagtatgagaggagacagtgcccgacgtatgcacagatgaacacatgtatggaaggataagtatgtgttcaagggtggacacatgtgaacacagacacttgtatgtagggacaaacatttgcgtgcagggacagacacacacatccaaatagacacacaggtgcaggagcagacacttatgtacacaaatggatgtgagtgtacatggatagacacacatgattgtcctttgtgggccccagaacctctcctgcacacacttgcacacacatgcacactgactcacatgcactcacgtgtgtgcagggcctggtctaccatgcacaccatgcatatagggtccctatgcatacagaaaatccccaaatgggcctggcatggtggctcatgcctgtaatcccagtgctttgggaggccaaggcgggtggatcacctgaggtcaggagttggagaccagccttgccaatgtggtgaaaactcatctctactaaaaatacaaaaattaagctaggtgtggtggcaggtgcctgtaatcccagctactccggaggctgaggcaggagaattgcttgaacccgagaggtggagattgcagtgagccgagatgacgccattgcactccagccttggtgacggagcaagactctgtctctcccccaaaaaaagaaagtccccaaatgtaatgtgtgcctctcatcctcagtatcaggagagtgctgagagcacacacggctgacattctctgtgtggggagccagcacatggccctgggagccaggcctggctgccttttggcctttgtgatcgggtcctgtactgtgcgctttactttctgtgccttggtctcctcatttcttagcgaggactgaagctgttaacccatgccaagtgcttggctttacatcaaatagtaaaagttactcttactcctgtctggtgccagcctaggctcatattacagacaagaggcctggggcagtggctcatgcctataatcccagcactttgggaggccaaagcgagagggtcacttgagcccaggagttcaaaactagcctgggcaacatagcaagaccccatttctacaaaaaattttttaaaaaaattagccgggcatggtggtgtgtgcctgtagtctcagctattcgggaggctgaggtgggagtatcacttgagcctgggaggttgaggctgtaatgagctatggtcatgccactgcactccggtctgggcaacagagggagatcctgtttcaaaacaaacaaacaaacaaaactgggcccagaaagagtaaggtccttgcctgggaccgcacagccagaaaatggcagattcaagattcaagtaccctgaaagtcttctgtgcccagaaatacacacacagggcccacacatccacttggaaggatacccaggactgtgcatgcacttacagccaggaccgtggccacagaaaggccctggggtcagcagaggctggaatggtcagtgggaatgttccctcccagccagggcttgcaaattccagaacctccagtgatagctttcgggagcctagattcttcctactctaacctctgcctaaaattccatttcttcttcttttccttgctttaagcaagggtcagatgattccaatgcctgcagatgctaggcaggtacttaaataagttaagggtgaagcaataggggttggtggagactgtgatgggtgtgattcattgccacgtaggaaagccggcccgctgctgtgggaaaacgggaagtcagaattgtaatagaatttttttttttaaagtgactgagtcttgctctgtcaccaggctggagtacagtagtgagatcatagtccactgcaggctggaattcctgggctcaaaggatcctcccctctcagcctcctgagtagctgagtaggtgcaagccaccacgcccagctaatttttgcatttttagtagagacagggtttcaccatgttggccaggctgatctccaactcctggcctcaagtgatctgcccacctcagcctcccaaagtgctgggattacagaagtgagccactgtgtccggcccacacctggctattaaattttttttttttttttttttttttttagagccagagtctctccatgttgccctggctggttttgaactcctgcgctcaagcgatcctcctgcctcagcctcccacagtgctgggattataggtgtgagcccctgctcccaggctgattttgtgggcaagaaattccagttgtttctaactctgtgggggtcaaacaagtctcctctgtccctctgtgggtctggttggtccgagcaccccccgtttgtagtctctgcctgttcactgaggccagaggctgggtgcttgctgtgtgccctagggaagggcctgggcttctctgtgttcaatttcctcatggccagaccctggggaggacacacatggtagagagctgagactctccaggggagagccagacctggacagcagaggaaggaccgtcatgcctgaaaaagtcatttctctcctcatccctactctgcccgtctcctgctatccgcagggaacttaatggagaaaacaccctgccagtgcctgttttcctttccatcctgcggtgggtgccagctccagatgagtgactcagggcttcccatggcagcagataaacactcgctctgatgccccgggaggaggccgggcaagcagccccagagcagcaggcagcatcaggtggagaatgagggtgggggctcagctcagccaccttttctaggcctttcagggcctgtcagaagctcccatggaagatgtggaggttggggagcagtagacattcacaggcctgggaatgggggtgcttgagtatctggggcacccacgggaaactctggcctccttaggcttaatgggtggagccgggtggatagaggggtagggtgtcagaattggcttaagaatttcagagtgggccgggcattgtggctcacgcctgtaatcccagcactttgggaggctgaggcaggtggatcacgaggccaggagatcgagaccatcctggctaacacggtgaaaccccgtctgtactaaaaatacaaaaaattagccaggcatgctggcaagcgcctgtagtcccagctaatcgggaggctgaggcaggagaatggcgtgaacctgagaggcagagcttgcagtgagccgagatcgcaccattgtactccagcctgggcaacagagcgagactccgtctcagaaaaaaaaaaaaaaaaaatttcagagtgaggcaggtcccagcaggccagggtcattatggcagccttcctggaggagggggctgaaagtagctctgtggctgctagccttgaagtcaggatacctgggctcacactagatggttggaaagcatgaaggcagtgactatgtcatctcagtcacttgtgtcctcagctcccagaccagagtctggtatacagcaggcactcaataaagatctataggccaggcatggtggctcacgcctatattcccagcactttgggaggccaaggcaggaggattgcttgctgccaggagtttgagaccaagcccaggcaacatagcctgtctctccagaataaaaaacaaacaaaaacatttagccgggtgtggtggcactcacccatagtgccagctcctcagaaggctgatggggaaggatcccttgagttcaaggctgcagtaagctatgatggcaccactgcactccagcctgggtgagagagtgagactctgcctctaaaaaagtaataattaaaaaaatatttgtaggccaggcgtggtggcttatgcctgtaatcccagcactttaggaagccgaggcggttggattacttgaggtcaggagttcgagaccaccctggcaagcatggtgaaaccccatctctactaaaaatacaaaaattaaccaggcgtggtggtgggcacctgtagtcccagctactcaggaggctgagatatgagaatcgcttgaacccaggaggaccttgtctcaaaaacaaacaaaaaaaagatttgtaaaatgagatgacagaaaataatagctttagggaacactcaccctgggctaagaaccgtgaacaaccctatgaggtaggtgttattattatcttctattttatacatgaggaaactgaggcacagagaggttaagtaatatgcccaaggtcatacagctagcaagtgacaaccagggttcaaacccaggcctgtctgcaaagcccagggcatatcacttcctgaatggttcgatgtctgtcactcccacggggcggtgagggccataaacgctgggcttatctgttttggtccctgctcatctattttggcctggcatatagtagatgcttaataaatacttgttgaataaattacaaaagtcctttgggtcctcagacaagtcacttctctccaagctttggtttccccatctatgcaatgggcatactctaagtaccaacctcattgtgttgttttgacaaagaaatgaaagagtggaggaggattgtggctctgtaggaaaagttccagagtcagccagactgggttcaggtctacactgcctacccttccagctgtgtgaccttagacaagttccccaccctctctgagctgcagttttcttatctgtgtgatggaacagtttggaggctgggaatctgggttctctcgggcccctgtcaagctctgcctcgggtaacgactggccctggagcctccacccctcagatctcaggggcactaaagcttctgaggaggtggcttctggactcatctcagacggggcaactcaccccagcaggcaggcagagaggatggctctctttgggcctgacctagggctaagaaccttcttgttggagtgggacagggcctgagctcagagttccagctgcctagcaggtttgagcttgcactgggttaagcaacgccctaccccactccacctccaacgagggagatgggagctcttttgaaccaagcacctgctgagtgccaggctcctgctctgaaacccctcaacctccctctcctgtgaggtgggggccagggccatgcccatttcacagacagaaaaacaggttcccagaggaacctcacccaagatcatagatcccagctcctccagctctgagctgtctcctctgcctgacccttcttagatcgaggagggagatgggtgagaacgttctctccagagaaggaaggagtctgatgactccacagcaggcaggaatggcagctccaactctctttaggggtctgtgtcattttgcagccttaggagcagcttaataccattttcagatgagaaaacagcccatcttcttctgcggggtgagcgctccttctccttacactccctctctccctcccccttccctccgagccctgagtaatctgcccctatctcttgctgttcctcagacatactgggcgcacttccaccccagggcctttgcttatacaggtccagctgcctgggacgccctttctcctcttctcctggtggctccttctcttccttcaggtctcagctcaaacctcatctcttcggagatccctcagcagccctaaagcgcccccagctcagccccctgttaagttttctttcatgtcctggtcgtatctaatgtgatctcactggttgcttcctttgctggtttcttctctgtctccccactggaaagtgggctccctgagactgggtctgtccatcccgttcatgctgtgtccccagacctagcccagtgtttggcaagtccgtgtctgctgcaggagtcttctgaatgaacttgggcatagctaaatgcctggcaaagtctctagtgacatcagctgcccgaggggagacaagttggaagaatagggaaatcacacaaacttgggttcaaatcctgcttgctgtgttaccttaggcaagtgccctgtgccctctctgttttgttttgttttctttttctggagacagggtctcactgtattgtccaggctggtctggaactcctaggctcaagagatcatcctacctcgacttcccaaattgctgggattacaggggtgagccaccgtgcccggttgctctgccctctctgcttctggacttccatttcctcggctagattgagggatgaccacagtgactatctccaggattgttggaaaacctagagattcgatgagaatgggaaccagccagccccaagtggtgcccatatactgtcatccctgccaccctcttcaccttcccagccccgaagttccccagctggcagggatgagtggagaggcccctgtcaatggtgtctgtgctgaacaagtcccatttgctgctgcctcctccccaggccagaataaacgtgcacctgccccaggtcacagagcacacagcagggagccgagggggtggggcagggagctgagggctggagcagggctcctggtgtctctgaggacaaaacagtccattgtggccctgtgggtattgagggaatcacagggcctgaatggaggcgggtgaggaggcagggcaggtgtgggagcaggtgtccacggtcatcccacggcatcgcccctggggggaagtgcccccctatgcgtgccctggaaccggcctggctggtcggacacctgtcccctgcagcttcttgtcaggagacaacataggcgtgagccaggccccaggggtggggtgggatgagggagtggggggtgggatgagggagtggggggtgggatgagggagtggggggtggggaagtagaagatgggaaggatgggactgggggacagagactctggggtctagggcagagagacccaggatagaatcccagccctgctccttcaggctgggaacactggacaagtcacctctttaagcctgtttcctcattcacaaagtggggctgaaactcccctctgtgccccagtgaattttccaggcacacgcatggggcggggtatggggggctttgatgatttggggcctcagtctgcccacagcctccctcccagaaagggttcatcattcttttactgaagaaacacttaatttagaaaaggccgggcgcgatggctcacgcctgtaatcccagcactttgggaggtcaaggtgggaggatcgtgtaagtccaggagttcgagaccagcctgggcaacacagcaaaccccatccctactaaaaatacaagaaattagcaggcatggtggcatatccctatagtcccagctatttgggaggctgaggcaggagaattgcttgaaccccagaggcagaggttgcagtgatccaagatggcgccactgcactccagcctgggcaacagtgtgagcacctgtctcaaaaccaaaacaaaaacacactcttattgagctcctactgtgtgccagaaccatgctaggtgctggggacacaaaagtgagtgggacagacaagtttcccttactggggaagaagacagaacatccaaaggataaagaatgagcaagagaattccagacagtgatgcgggcaccaggaattaaattgaagttgtgctggagggtgactccacagtgtggtcaaggagggctctctgaggagggacctgaagccccgaggaggagaagcagaaaagaggagcaggtggggagacctgggggtgggctgcaggcttcaggcaaaggcctgtggtaggactgagcttgcatttgcacttgcagaggaagtgcggggagcaccccagcccaggaggtatctggcccgaggggaccctctcagcctacccctgcccctccctgtccccggaggctgaggctaagaggcaaggtgcgggccaggctggaggaaatggggccaagacccgtctggccagcagactctcctgggactgctaatatcccaagtgctggtgacaagacacagccccgggtggcagggggctgggggcctgagactccgtaaacagccctggctcgtaaagctgatcaaagcagcaggcctgtcccagccctggccacttcctgcagggcccagagccctggcctgtgggagatcctgggaagggcctctcagcagaggctgctttggggtctctaggcactgggggcaggggcaggggcagggccaggtccccgagcctgtcctggcttcggttttccctcttgttttgcaatgaagactggctggaacctctgagaagcctgtttcactgcatgtctttgacaaaagcttggcctctggaaccggaggtctgggggtttgaatcccagtcctgctacggtgtgacctcaggcagtgacacccgcacctcccctaccgcccaaaactgtccttagctctaaaatgaggataatgatggtacctatttcaacagccttagactgtgaaattttattgatatgatttctaattatagttcattaattatctaatgacaacagtgacagtagcaggcatcctggtggaaaaggcatcccaggttgcaggactggctgaggtttgtggagccaacggcaaggattgttgggaaggtcccggctcccatgtgctcctcctgggccaggtctgggcaaagagaggccccgaggtggaggatttccaggcggagtggaggttgccagggctacagcccctggcctgacgtgaagtagcttttcccaggcctggctccaagaccccaggggtctcactctctcaaatcggcctgagaagatttgaggatgaaaacagacccaggactcggccaagtctcccctccctgttacccactcagcctggccccaccctctcacgcccggactgttgcggtggcctcctgggctccctgcctcccattcagtccccttcggtccccttttggccacagaagctaagtcagacagaccctgtccctctgctcagagccctccagggttcccaccccactcacaaagcctgagccctcccacagcccacaggcccaaccagccaaggcggagtaggcctgtcacctcccaacgcctccctgtcactcactgagataccgcctcaccacgtaaaaccaccacggcccgcatgccagctgcctctcccggcctggtgttttcattttctttagcactggttcccttctgacgcctggtataaaatccctgttcatcttctccgtctctgccacaggagagtcagcaccatgagggcagggatttttgtttttgttttcttccattttgttcccagccatatctatacccagttcctaaaactggaggcacttaataggtgtctgtgggaggcaggaacgggtcctcaccagctctaggggcaggtactatcgttatttccactttacgaaggaggaagtgaaattgagcaagacctcacacagctgggaagcggaaagtcagtgccttgatgatcatgatgatgatgatgataacaacagctaagatatattaagcacctactgtgtgccaggcaccgttctgggtgctggaacaatagcaaaagaaaaacaccaggtgcggccggcaaggtggtgtgtgcttataattccagcattttgaaaagccgaggcaggcagatcacttgagcccaggagtttaagaccagcctggccaacatggtgaaaccccgtctctactaaaaatacaaaaattaggctgggcgcaatggctcacacctgtaatcccagcactttgggaggccgaggagggaggattacctaaggtcgggagttcgagaccagcctggccaacatggagaaacccccatctctactaaaaatacaaaattagctgggtgtggtggcgcatgcctgtaatcccagctacgagggaggctgaggccggagaatcgcttgaacctaggaggcggaggctgcagtgagctgagatcgtgccatcgctctgagcgacaagagcaaaactccgtctgaaaacaaaacaaaataaaacaaaaaacagcacgaaaattaacctggtgtggtggcacatgcctgtaatcctagctgctcaggaggctgaggcaggagaattgcttgaacctgggaggcagaggctgcagtgagccaagattgtgccaaggaagaaaaggaaaagaagaaaaataccaggtgcattgtaagtacgttacagcagataactcttggaatcctcagtggggccctctgtggaggggactattactgtccccatttcacagatgtggaaacagaggcccagagggattaagtaaccggtctctaacaacaacagctccaacagcagcccccatgtactgagctgtgctctgggccctggcattcacccggtatccctcacctttcctacgcttttggttatcctctacagcaaagaacccagcctctggagaagcagtaagtcccagcccatttcccaggctcttctgccccctgggcacacctggtaccaggcatggacaggcccaaacaccgaggccattgcacatttgctgcctcagagggactcaccttggtgtctcagtttcccaagactcttcggggtctggggcccatggaacgggtaagcagttctttctcattcacacctgggacccctgctgtccccagggagggcctgaggaagtgttggccactctgctgtgtgaccttggacaaactgctgtgcctctctgatcttccaggctcaaccaactccatggggtggtggcttgctgagaaaactgtgggctaggatctgtgagccagggtctgggaggagtgaggaccattcatagaaagcctggcaactgggagcacctgcatcctgcctgggaggaccacgtggagggagcagagccaccttcacccctgtctcgggcctgttttcccttcccgctctgccctgtactttgcaagcccccaagagatggggttgggtcctgtccactgctccccctccctgttttggccacactttctcactaggaaagaaaatgaccaggaggccacattctccaggcccccaaagcctgcaccagggtctctcccaatccacatcattccaccttttcccgctgccactccacctctgtgaccccttctcctgtcactcagtccttgcaataactaaggattcagccagggttatggctctgcctcttttttttttttttttttttagacggagtctcgctctgtcgcccaggctggagtgcagtggcacaatcttggctcactgtaagctccgcctcccaggttcacatcattctcctgcctcagcctcccgagtagctgggactacaggcgcctgccaccatgcccagctaattttttgtatttttagtagagacagggtttcactgtgttagctaggatggtctcgatctcctaaccttgtgatctgcccgcctcagcctcccaaagtgtggggattataggcgtgagccaccgcgcccggccggctctgcctcttttgccgattgggagacaagtgcaaagaggtacctggcatggttctgagtccagggaaagacaggacgccatccccagagggccatggtgatctctccagaggccagccctccccactgtgcccttgcttggggcaataatggctcagctgatggaccacgcgcggtgtgcactgtcccccattttaagaaagagggaactgggcttcagaggggacagccacctgcccgaggtcacccagccaggaggtggcagtgcctgtctgatgcagagcctgtgagtatggtgggcaggggagaatgaggcccagcgagaggaacggccctgcccaaggtcatgccaccgctaccagggcgcagaccccccaggctgggccagtgctgagagcactggaatcccaggcagagtcttcccatgaccctgggtgggggtgggggctggcctggcatttcctgtttgggcaggacccagggcatggcctgagtggggagatagggagacttcctacggcccctccccgctcaggaactagcccaggatgcagtgcggggcagggttggggcccgtgtcctgggtcccaggccagctctccccttgatatcctggtggtcttgttctcgtcccccaaccccacctcagagtctccacatccttggatttctccattctgggagttcaccattcaatgaacagatccagttccaggtctttaggagagcctgaagccatgaccttggacaatcacctcccctctttcagcctcagttgcctcctctgtcaaacagggtgattgattgtgaggatgaaatgagaagtcgcctgcccagcacttcgggaaccccactgccccaagggagaaagtcaccaaggtcctgacaatgacctcatgtgcttcccagacacagacccgaggccacagaggttgggggacctatgtgaggacacacagccagctgaggcctctccactgccatttcctgggacacagccatgaagtaccaagagggtgcactattgtgtccagtgcactgagttcaccccagccatgctgctcactggctgtgagtggcactgggaaggtcaccttacctctctgagcctcagttttctcttcttcaaaataggaagaaaactaacctgatggcagaacttaatgagccgattaagtgcacaagccaccagtggcagagtctggcacctggtaattcatggtctccccagaggaggaggctgtggtccgctgtctcgggtcccttcgggtgggatgaagggcccccagctgggaagggtcgagtccagctgaggttattgggacagccaggagcagtggctgacccatgctctatgtaagcaggaccaagctcgtctgcacctcaacactccacagcgtctgccctgtcaatgctctggggtataggccctgctgacctctcccaccttattcccccaccacactcctttgctagcaccattctctaaccacgaagcccgctttgtgttcctccattctacaagctcattccagcctcaagatctttgtagctaaaggtctctctccctaggtcacacacccccacccccatatttcccctattttattttttatttgtatgtatttatttattttgagacggagtctcgctctatcacctaggctggagtgcagtggcatgatctcggctcaccacaacctctgcctcccaggttcaagccattctcctgcctcagcctcccaagtagctgggattacaggtgcatgccaccacgccaggctaatttttatattttcagtagagatggggtttcaccaagttggtcaggctggtcttgaactcctgacctcgtgatccacccgcctcagcctcccaaagtgctgggattacaggcgtgagccaccttgcccggctcccctattttatttttatcttctatcattggaatctaaaacaggacctagaataatttaggcactaaataaatgaaaggcaatgaataaatgaatgcattctgattttgaatctaatgagtctttgttttttaatagacccatttaactcatttacatttattgtttaaatggatatgtttggtattgtgtgattctgtattgtgttttctgttaattgactgattgaatgaatagatgaatgaatgagtgagtgaagcaaagtaaatttcaggttgctggggtgggctgaagattggagctttcctgggctatccagggtgaaaagagcaatggcattgaccctagacccctcacttttgcaattatttattccacagcccttgatcccccagatgaaggatctgtccattcttctcatctccagcctctccaatgtaaccttcatcctgtccctcccaaaccacctccccacacagggagcatcaggcttatgattctgggttgtaagttagattctcattcccatgcctgctcccccattaactggtggtgtggccttgatttacctgagtcttcatttcctcacttgtaaaatgggatcatagtatttgcttcctactatgactgttgaaaggattacatggaacaacttgggtcaaagggcttagcacagtgcctggcttagagaaagcactcagcaagctaagatttcattattattgttgttgtacctcagtttccttccattgtaaatgaagctgattttcacttcctttcaggcaccttaggatccctagcctcaaaatctggagctggggaatctgtccaacccaccttctcactgtgttctctaccctcagctcccagagagggaatttctggggactctaggggatcctcagaggcctgacctgccaccaggaggtggggagagaagacagcacaaaaaatgtgaaagcttcttcagggactgggtgtggtggctcacacctgtaatcccagcactttgggaggccagggcaggaggattacctgaggataggaatttgggaccagcctgggcaacatagtgagaccccatctttacaaaaagctaaaaaaaaaaaaaaagagcttcttcatgccatctctgtggccacatcagcattatccccacacacagatgaggaaactgggactgcactcgctcatttaattccacagacacacccccctgagcacctactgtgtgccaaactgtgccaggccacagggcaggcagaccaggcctctctcccccagggctcatggcccatcagggaagacaggaaatagcaagtcagcccgggaggatttaaatcaagcgccttgcccagcccttcaaagcctcctagagaattttccagcatccctgcctggtgggcggccctgctcccttgctcccttttctcaaaagagaaagcccgaggccagagaggggcgttcccagcctggctggagtcacagcttccgaggggtggtgacagtcttcctgcctttgccccagctggtgtccctgccgggaatactcttctcctggtgggctgccagcagatcctgcccagtgctgggacactgccgggcgtcacttcctctgggaccttcctggctgagagggcaaggcgctgacactcttgctcagcgccagagggtttcctctttcataatgagtttcctactcactaggaaggtctgcgtcccttgagactctgagcttcacgaggggcacaggctttgccatcttcctggcacctctcacctgcccaagcaagatgggaacgaggcgctgctgggtccctttctcaggaagacgcccctacctccgctccaggcgtggatggcactgaaggcctctccctgcatcttctcctgcttcaattctgcacttggtttatggagttatttcttttgatttttcttaagaccttaagtgcttttttttttattcttcttgcccaggctgcagtgcagtggcatgatctcaactcactgcaatctctgccgcctggtttcaagtgattctcctgcctcagccccccaagtagctgggattacaggcacccgccaccacacccagctaatttttgtagttttagtagagacggggtttcaccatgttggccaggctggtctcgaactcctgacctcaggtgatccagccgccttggcctcccaaagtgctaggattacaggcatgagccaccgcactcggccaagtactttatttttttaatttaaatttttgtaaagacagggtcttgctatgttgcccaggctgatctcaaactcctggcctcaagcaatcttcccacttcagcctcccaaagcactgggattacagccatgagccactgtgcccagcctgtggggtcatttcgttgtctaactccctttctagaatgttgtctctgtgaggacaggacttttgtctgtttggggcaccactgtgtccccagtgcctagcatggtgcttggcacataggtgcttaataactatctgtggaaggaagggaagaagagagggagagaggaagaaaagaagaagaggagggagggagaaagaagaagggaaggagacagggaaggggaggttgccatttatttgtccagtttttcatttgttcattccacaaatacttattgagcaccaattgtgtgctagttctggggagagaatggtgccagacacagacacgatcctgccggcaaggcactgactttctggttagtgagaaccagtcaggttcagtggcggaaagtgtggggaggcaaggtaaggtgggcgaggggctgcagacagcatgtcgggggcacctgggccaggctgctggcaggagggctcagctggcagggacaggccccggctccccctacccccagctggcagatgcacagggctgtggtagctgtgggcagcccggttgccaaatgccaccacagctgcgtcactgagagctgggagggccccaaggctgagggggctgggaggggcccccacacccaggctggctccagccccgaagcagatagaactggtcaaaggcctgccccgtgcccactgttccccactctatgtgatgtggctacatggctacttcctgttctggaccattttcaatttgcaaaaaaaaaatggtgcaaaaaatgtgttaaaaataaaatgaaaaagaaagaaatggtacttgagcctctgtacatgttcctacctccaagagagaagttaaccgtggcagtgaccgtgggatgctcctggcatccttctgatctcagcccctccccgccccctccagaggcgacatcatcccgaacctggcatccatgactctgtgtgtgatttcatagtgtaactttcctgggtctactttagtgtgtccctgggcaaatcactcatcttctgtgagcctcagtttcctcaactgcaggatggggataatagtccccacgtcggaagagtcttgaaaattaaatgagtgcgtctgtgtaaagctctttgatgggcacctggcactacataagcattcgccagtgttgctgctggacacccagaacagggggcagacaggtgtcacttgtgtcaagaatataacttttttttttttttttctgagacagagtctcatactattgtccaggttggagtgcagtgatgcaatcacagcccactgaagccatgacctcctgggcttcctgcctcagcctctcaagcagctaaaaccacaggtgtgcaccaccatgtccagccaattttttatagagacaaggtctcgctatgttgcccaagctggtctcgaactcctgagctcaggtgatcctcctgcctcagcctcccaaagtgctgggattagaggcatgagccactgcacttggccaagaacccaacctcttaaacaagctcatgcgcggcggtgccaggattcacaccagtggctggctgcagagtggcattacagaggagctgggtgttagctctggtttattctgtttcacttcctgtcagatttgtctccctgatcagttctgaaaaaccagggtcagtgcctggctggttctctgctgtcacccctgccccagccctggagactccaaggatgggtttgtggagtgaacgaaggggactcagtttcctcatctgtgtgatgggtcttacaggccgtaggaaggcgagagtgcccaatgtgaagtagatgctttataaacccttgtttgtttcttcctcttccagctggacctcctccccctcccccaggtctgggcctggaccccactaccttcagggcagccatcatgctgacagagccctccgaggcagtcagactgggctcgtcactgactcactcattctttcatataatcatatattcatgcacactcgcattcaacaactgttttgagctgtggctcatgcctctaatcccagcactttgggaggccaaggtgggcagatcacttggggccagaagttcaaggcaagcctggccaacatggaagaaccccgtctctacgaaaaatacaagatttagctgggtgtggtggtgggcgcctgtaataccagctacttgggaggctgaggcacgagaattgcttgagaatcgcttgaacttgggaggcagaggttgctgtgagccaagattgtaccactgcactccagcctgggtgacagagtgagatctgtctcaaaaaaaaacacacaaatgttttgagcacccactatgcgccaggctctgctctaggctctggggacatggacgtgaataacacaggccaaaatctctgtcatggtggggctgacacctgtctggggagacaaccatcagacaatggttgtggcactgggtgacccaagtcagagggaagggaggggagggagagggggctgggccttatcctgagggtgatgggggcacatgagttggcagaggccagacttgatatacgttcttcatgcttcactctggccccagcagaagcgtgtgctggagtgaggcttagcacagatagaggtatccgcaaaccctgccgtgtcagacctggtctgagttccctaggaacaggcccatgatgtgggagccggggcttccactgtcccactgtcctcgcaggggatgggatcaggtgtcagcacctccccatggagtacagttgggcaatggccttgggcctgagggctgttcagtcctgtgaccagccaggccccttctgggaatggaaccacaccccaacccccaggcgatgacgtcccaccagggtgttccccacacagttcccaccagccccagatgaaaacaactcaatgctgcatccaccacccaaggcctcatcaaatccaccaggatccatccagacggcagaatattctggagtctcggacaggcaggatggggcggagttttggaccacaggcctggcctgaacctgagttctccagtcactgctgtgtggagttgggaaggtgccttgcttctctgtgcttctgtttccttatcctcaaaatggggatgatgataacaacagaccctcggccaggcatggtggctcccacctgtaatcccagcactttggaggctgaggtgggcggatcacctgaggtcaggagttcaagaccagcctggccaacattgtgaaaacccatctctacaaataattaaaaaaaaaaaaattagctaggcatagtggtgcatgcctgtaatcctagctacttaggaggctgagtgaggcaagagaatagcttgaacctgggaggcagaggttgcagtgagccgagatcaagccactgtactccagcctgggcaacagagcgaaactttgtttcaaaaacaaacaaacaaaacacaacaggcctggcacagtggctcacgcctgtaatcccagcactttgggaggccgaggtgggcagatcacaaggtcaggagttcgaggccaccctggccgacatggtgaaaccccatctctactaaaaatacaaaaattagccgggtgtggtggcgggcgcctgtaatcccagctactcgggaggctgaggcagaagaatcgcttgaacccaggaggcagaggttgtagtgagccaagatcgcaccactgcactccagcctggtgacagagcaagactccacctcaaaaaataaataaataaataaataaataaataaacaaaccacaacagactctcatgataggttcacttcaccctgggttaatgagttaatccatataaagcagcggtctccaacctttttagcaccagggaccggtttcgtggaagacaatctgaaaggggctgggggttgtgtggggggttgtgtgttgtgcatatctctcgtatatgcaatctgcaatagggttcgcacttctctgagaatctaatgatgtgggtgatctgacaggaggcggagttcaggcggtaatgctcgcttgtctgctgctcacctcctgctgtgcagcccggttcctaacaggccacgaatgggtacctgtctccagtccaggagttggggaccccgatataaagcctcagactgtgtctgatacagactaagccctagagaaactttgctgttgctatgattattattgacattattgatattattgacattatcattaggtcgggcacggtggctcacacctgtaatcccagcactttgggaggctgaggcaggaggatcctttgagcccaggagttagaggccggcctgggcaacacagcgagacctcgtctctagaaaaataaaaaaacaaaaaattagctgggtgtggtggcatgcacctgtagtcccagctacacaggaggctgaggcaggaggatcacttgaatctaagaggtcgaggctgcagtgagctatgattgtgccactgcattccaccctgggtgacacagtgagactctgcctcttaaataaataataattaatttaaaaataaaagcattagcagtagtagtagtagtagtagtagtagtagtagtagtagaagtatggattaatccaagggggaaaaaaggagggagtgggactgaggtaaagcaagctgctacttggagaaaaaggtaaagaagatgaccagatagatgcgtgtgtagatgttcacaccatctccagagacccaagagactggcggcagtggtggagggagtggggacctgagggaggggaaaggacaccgactttccaccctttgtccccttccacgctgtttgggttgttcctttttttctgtgcacttgtgtggatattcaaaaccaaacactacagaaagaaattctgcaagaggtttccttccttagcgaaagccccaaatcgtccctctcagccccgccccctcccacccccacatcccggcctgtgggtggcccagtctggtctcccacctctgctggtgttctgcgctcctggccttggagcaggtccgagctggaatgccctgcaagaaagggggctcctcagagtccctcagagtggccctggctctgggcagccaggggtgtggggctttggggaggggggtcccggctgactgatgagaactccaaatgctccccagccccggctgctaatcacttccagattggccgggtcagggccagggccgccgccgcctggctccataaacagcccgtcgctccagatggcggctggctccagcctggcgagcaggttcatgggggactggggggtggcagcaggtggaggacccccacctcactagccgcctcagctgccacacctccacaccgccctgagttggggaccctgggccagaaggggtggcagaaactgaacccattgctcagaggagggaaactgaggcccggaaggggcaacgtgggtggtggtcaaggtggggggaagacagagatgtaaggggggtgctccttgagggttgatgctgggttcactttacctctgtgaatccagcacaccatgaggatgccgtaaagacccgaggagggagggaaggggggcatcattgccagctgggtttaaattctggctccagcttttactccctgagtgaataaattatttccacccccagcctcagttttctcatctgtaaaatggggatggctggagtacaggattgctggaagattcaatgattcggctcctgcagacagtttgcactccacacacggcgcaggcgctgaacacagcttctccctcttccttttccggaaactccttctattcctgcttctcctgccgccggagagcacagtggcctcctccaggaagccaccttgacttttactcagacctctccctttgtgccaggcactgtgcttttcccacagcctctctcacagggtctctcctcgacacaactggcacctgacgctcttgtccttttgaaaacaaggaaacagagggtcagggaagtaactggtacctagtgctgttagggccccgccccttgcagatgaggagacaaagggccagggaggcagtgggatggatatgttgaggtcgccaggaaaagacagcctgatgtgcacctggagctgtctctgaaggtctcacagaacctggcacagcgtcaggtaacccggctgcctctcctgccacacccaccaaccccagagcccacaccttggcacagaaggaagagatccaggctggtgctgggtcgtaatatcccagggaaaggggtaaggagccttgacctgctcccatacctgcctgtctccaaactgggctggatcctggctgggtggccgctgggtggtagccttgtcccaggacacccggcagcaggacaaggtgggggagccagttgctctgtgagttcccctcaggaccatcccttcctgctccgctgagcagagacacagctccccgaggcctgagtccccatttttcaccatctttatcctcgttcctggcacagaaaagcctcagtatcactttgtcgaatgtggtattgagtgcatgggtgaggcactcctccaagcaacttactacagtaactttttaaatgtttacatagccctctgagaaggggactattattattgcccgttcacagatgaggaaatggaggctcagagaggttaagtgacttactggaagtcacacagctggagctaggatttgaactcaggtctcctagctccagcgtgcacattcttgcccacatgtctctgctcccagggtagcagtgagcctgaaatacgtgcagtgcctggcaggtagtaggtgcttttccaagcccttcttttgcttcactcagccttgaggtcagcggcccgttctgccctgtgcctgggaggaatgttcgtggtggccccagcctggatccgagaagaaaggcagccttgtgggcgaaaggtgagcggctgggtgggcgcgggcgtgtttatccagggccggcgtgtggctcggggtggcgccgctgtcagccgcgccggctgccccaggcctgtgctggcctccagatgtgagctggctccagccggccgggcccccccaccccacgcacagaggggctttatcaaaagcggctgtgaggaggcccaggaggccgcctggctccagcctgctggctctgagccccgggcctgcagaagccaggccagtcgcacttgtgctcttgtgccctggtcttcgtgtgctccacggcccagctcctctgttctcctcgagtcccctgggggcccaggcgagggacagcccctttgccaggaaactgaagctgcaggagcagtccgggaggggtaacaatgccagaaccctcctgcagcgtttatttttctgcattccaggggggtagaggtaacccacacggaacaaaagtgcaaaattcatcaaaattcagagagtgctcagtgagacatcaaagtgtagacactcgtgggaaggagaaattgcagattcagagagccagttcttagcggggaggagagtaactggggttggggggtttgcaggggctatgttttctctgcggtattttcttttttaggtgggggtgggggtgttattctttttctttttcttctttggagacaggatctcgctttgtcatccaggctggagtgcagtggcgccatcgctggctcactgcagcccttgacctactgggctccagcagtcctcccacctcagcctcgcgagtggctgggactccgggcacgcaccaccacgcccagataattttttaaaaatagagacagggttttgccatgttgcccaggctggtcttgaactcctgagttcaagcaatcctcctgccttggcctcccaaagtgctaggattacaggcgggagccaccacgcctggcctccagggatgctattctgtatattttattcagtggcctgaactattttgtaataataaatcataataactgggaaaaaaaacagagaaaaaacctgagacatccacctgctcccgaccctcagccctactcctgttaaaaatggcttctaatgctttctagagattgtctgaacacccacaagaaaatccacatacattctctgtcctcttttgtttttggttttataaatagtatcaaaatatagtctgagcacagtggctcacgcctataaacccagcactttgggaggccaaggtggacggatcccctgaggtcaggagtttgagaccagcctggccaacatggtgaaaacccatctctactaaaaatgcaaaaattagtcgggcatggtggtgagcacctgtaatcccagctgcttgggaggctgaggcaggataattgcttgaacccgagaggtggaggctgcagtaagctgagatcacgccactgcattccagacagaatgagactctatctcaaaaaaaaaaaaaaacaaaaatgctgctctgcacctggcttttttcacttagcagtatactccggccctctctgcaactgtccttgtttgcagctgtgtggtattccaccatgggaatgcaccacgtccagttttccaggcccctgttgatgatgatgtaggttgctgcctgaggttcactactacagaccacactgactacgggcacccggtgtccgagtcttcgaggactcaggcaggtgctgtctagactctgatggtcaattcttagaggtagagctgtgcagggtagacacttttcctcttctgagagccattgctaatttgctttccccaaagtgtgtgtccctgtgttgtcccaccagcactgcggctgaaagggaaactgaggcacagggacagttggctgttcagaagggtgagagaaaacagcttcataaggaatctctactaaaacaacatgctttctcggtttcgtttctttctgattgcaaaagtgaaacatgtccattgaacaaactttagaaaatacagagaattgcaaagttagaaaagaaggcctcctccctcctccccacatacctacctctagtggctggacaaagacgagggtttgggccgcagggcaagctgcctggtgtccttgctatccccatgcctgacttgctgtgtggccccaggcaagtctcagcctctctggacccctgtgtcctcatctgtaactgggaatccaagggtgccagactcgaaaggctgttgtaaggatcaggtgagatcacgtgggtacaggagtggcccagcacaaaaggtttcataagaggaggctatgataggtcttcctcctgcccctccgcttgtgcggctgaatccaggatttttcccttgacttgccccgcacagtgaggcctggcattttcttcccgctccccatgctggcacgtgacacagccccgggcacatgggaggaacgtgataaatgctaatggatggcccgggaacgccctgtcctccaccaaggtcctgaagtctgagcagtggttggtgacggaagacctggatgcgaaaagccgaccaccagagtcaagacccagagaaaacagcaggtgcctgaggcaaggaagccgggattcccagactctggcagcctggccccagctgtcccagagggcaccccgccagcccctgggtccactccacccagggtccagccctgactgcgccaatggcagcaaagatggcagggaccccaagggcaacttcccaaccaccagcagcatttagggagcaccaactgtgtaccccactctggactgggcagcatagagattgtaccgcagtgaattcctggggaccaggggtggtgacttcattgtcttcctgtccctagagcccagcactggctactcatggattcaaacatttatggtgcacctactgtgtaccagtgactatgctgagtgcatctgcctgccaagagagggaatttctggaccatatatttagggaggggaggaagacagtgcactttctttttttttttttaatcttttgttgttgttgttgttgagatggagtctcactttgtcgcccaggctggagtgcagtggcacaatctcggctcactgcaacctctgcctcctgggttcaagtgattctcctgcctcagcctccaaagtagctgggattacaggcgcctgccaacatgcttggctaatttttatgtttttagtagagacagggtttctccatgttgaccaggccagtctcgaactcctgacctcaggtgatccacccgcctcggccccccaaagtgctgggattacagatgtgagccgccacgcccggccgagagtgcacttttctatcaaagttttttttttttttttttttaactgaaagcagtcttttcgtaagtaaataaacataaagaattcccaagttaagccgggagcggtggctcatccctgtaattctagcgctttgggaggccaagatgggaggattgcttgagcctgggagtttgagaccagcctgggcaacatagagagacaccatctctacaaaaaaaatcaaaacattagctgggtatggtggcgcctgtctgaagtcccagttactcgggaggctcaagtgggagagttgcttgagcctgggaggtcgaggctgtagtgagctgtgattgcaccattccagcttaagccacagagcgagaccctgtctttaaaaaaataaaaaattcccaagttagaaaaaaagacaaccctaccacctaccagtgataggaggaagttcgggggccttgggagcgccagaggaagcacctgacatagactgtagggccaggagaggcttccaggaggaagtgagttccaggcaacgaccccaggaagcatgagagggaagttgggtggagggaaataggcctttgggaggccgctgcccaggcctggcaaggcaggctgggtgactgggtgctgatggtctcacccatcccagcccagccgaaggtgagggctctgtccgatgcttcttggcagagcttattgcagttgtaacgaaagcatcacttctgtaattatgtttctgtcttcctccctcccaccccacctctgaactggagctctatgagggcagagcccgtcctgtctgcctcatccaccatactgtcccctgggcctggagcacacagtaggtgcttatggtggatgaccttctgttcccctgaagttcatgtctaccaggaacctcagaatgtgaccatatttggaagtaggggcattggctgattaattagatagggatctccagataagatcacactggagttgcggtgggcccgaagtccaatgcctggtggccttgtaagaagaggagtgggaaggccaggcatggtggctcacacctgtagtcccagcactttgggaggctgaggctggtggatcacttgaggccaggagttcgagactagcctggccaacatggtgaaagcccatctctactgaaaatacaaaaattacctgggcgtggtgttgcacacctgtaattccaggtactcgggaggctgaggcaagcgaatcacttgaacctgggaggcggaggctgcagtgagtcatgatcacgccactgcactccagcctgggtgacagagcaagactctgtctcaaaaaaaaaaaaaaaaaaaaaagaagaagaagaagaagaggaggaggatacacagagaggcacagaggagaaggccgtgtgaagacagaggcaggaactggagagatgcggccacaagcccaggggtgccgaggaaccctggggaacaccaggagctggaataaggtgaaggcgggtaattgcccggagccttcagaggggcgcaccctgctgatgccctgacttcagacttctggcctccagaactgtgggaggacatatttctctgtctctctctctcctttttttttttttttttttgagacagagtcgcccaggctggaggcgcctcctcccgggttcacgccattcacgccattctcctgcctcagcctcctgagtagctgggactacaggcgcccgccaccacgcccagctaatttttttcgtatttttagtagagacggggtttcaccatgttagccaggatggtctcgatctcctgacctcgtgatccgcccgccttggcttcccaaagtgctgggattacaggcgtgagccaccgcgcccggcctttttttttttttttttttttttgagacatggtcttgctttgtcgcccaggctggagtgcattggtgcaatctcagctcactgcagcctcgacctctccaggctcaagtgatcctcccacctcagccttcctagtagctggggctccagacacgaaccaccacgcccagctgatttttgtattttttgtagagatgggggtctcgccatgttgcccaggctaatacttctctttttctaagccaccacgtttatggcagccctggaagactcgttcggattttgctgtgtgaataaatgtgtgaatgaatgaatgaatgagagaaggaatgaatggagagctcctttgagttgtgcagggcccgcggggtgtggccagatgtctgcctaagggccatagggagctatggcagggtcccagccgggagctggttgggtcttcctagtagctgggactccagacatgcaccaccacgcccagctgatttttgtattttttgtagagatggggtctcgccatgttgcccgggctgatacttctctttttctaagccaccacgtttgtggcggccctggaagactcgtttcggggcatttcagggctgttgttcaggctgtgttgggggctggatgctgtccagccagtgaggtgggggctgtgaagagctgttgagggcccggcctcaaggaggtaaccaggaaatcaggttctgtggaacccctaatcccagaagcccatgtccacacccaacgtggacacccacagccgagatttcgggggtctctccccttctggtgccttgcagataagttagagccaatgtttatccccgagttctgaatgcacctcagaaggtccacccaagtgagtctcatcaccttcggctacagcccagagctcaggcagttgggagggaagttctccacctgtctgcccttcgtccctcttgctgtgactctggaagtcgggaggcagcaggatgcaggggaaagagcctagatcctgactctgcccagtgactggagtgactgttcctcactaagccccattttccccatctgtaattggggaaaagtcatctggctttgtagaagctgttgtggagagtggaggccaacatgggctggcagaacacccagcacatagtaggtgcttcctaggagaagtgggccctgggtcccctctccaggcacagccctgagtcttaaagggagactctggctttcccaacctcagatcttttgaaagccctgacaccttccctgtggcctgtccagtggccccacaaggccaccctatcccccaaggagcttgacaacctcggagggagtaagacttgaatttcatgctcataaaatgactggaatcaaagcagggcttatgacatggagctgttttgaagttggcccagggcaggaggggcgtgaaattcctggctgttttggcccctcttcagagaaactggggcccctggcaggatgtctggggcccaggcaggaggttaatggctggctacctgaggtacctgccattttagcaatgatccaaatgccaacatagacttttggggaaaaaattctaagttttagagaagacaaatgggaaaactcaattgaaaaccccccccttatctggggctggagacggtgaggacccaatggttgcagtgtgggaacttgggccctgtagctaggcttcccatccctgccttgccacttacttgctgtgtgacgttgggcatattgcctagcctctctgtgcctcagtttccttctctgttgagtgggcctaataccagtcctttcgtcaaaggcttgtggtgagggtgaccacattgacgtctcctgccctgctggcccagtctctgggcatcacaagctcagtcactgatgctgttactagcattttttttttttttgagatggggtcttgctatgttgcccaggctggtcttaaactcctgacctcaagtgaacctcccaccttagcctcccaaagtgctgggattataggtgtgagccactgcacctggaccagttaccagtatttttcctatagatatgaacagcttctcctgaattgagggctacctgtgaaccagccccttcataggcctcctctcaccaaatcttcctacagctgcatgaggcaagccatgcaccccccgaggcagatgatcagtgatgtctggacacttgcccggggcacacagccggtgagaggcagggccagaattccagcgccagtccttctggtggctcagtccacattcttggtcactttcctttaggaaatacggaaaggcgaggagaggaaagatatgtccccacacccatacagggagagcagggttgcttttctttgattttttttttttttttgagtcagggtcttgctctgttgcccagactggagtatagtggcatgatcatagctcactgcagcctcgaattcctggactcaagtgatcctctgatcctcccacctcagcctcccaaagtgctgagattacaggcgtgagccaccgtgcctcatgagaacagggtttctcaatgtcggccacattctgggcccagtgtgtctctgcgtgggggctgcctgtcctgtccaccgtgggatgcttagcagcatcctgggcttctgcctacagattgggaggccccccagagtgtgacaacccaaaatgtctcctccacgtgtcccagagaggggcaacccctgcctgagaactgggctggagtactggggttgaaatggtggagtgttttcttctggattttttctctaactacacacactggggaaatacagacacacactggggaaaacaggcatttcattgcatgccttgcattttctctttattttttaatttttaaaaatgtttgtcgacctggcccagacgtggtggctcacacctgcaatcccagtgctttgggagacagaggcaggcagatcatctgaggtcaggagtttgagaccagcctggccagcgtggcgaaactccttctctactaaaaatacaaaaattagccaggcttggtggtgcgtgcctataatcccagctacttgggaggctgaggcaggataatcacttgagaggtggaggttgcagtgagccgagatcgcgccactgcactccagcctgggcgacagagcaagactccgtctcaaaacaacaacaacaacaacgacgtttgttgacctgtcagcaggaagaaattttaaaattgtttatttatttacatacctatttagcattttctcataaaaaatacagctgggtgacatcacacatgcattgaacttaggcgaatccatgttcttgggctgggatgaaggagagagagcagtaccatgagtgataatggggtgatgctggcatccgtgacctgagccaggagctgtcacaggtccattggctggggctttcccctgtctttgcccttgtacagatggggaaactgaggctcagagactggacagggttccagaattccaggggtaaacctctggaacccagtgtggctccataaccagggctgcagatgtcgtcccctctgggtcaggccccccggtggctcctcagggtaccccctgtctggaccacttctgcaccaggggcccccaagagcaggataaggaatcaagaggggttgagcaggtgggaaggaagtgaggggttgggcccagtggcttacgcctttaatcccagcactttgggaggccaagacggaggactacctgagctcaggagttcaagaccagcctggacaacacagcaagaccccatctctacaaaaaatgcaaaattagccaggcatggtggcatgagcctgtggtctcagctacttgggaggctgaggtgggagcatcacttgggcccgggaggtcgaggctgcagtgagcagtgatcacgccactgcactccagcctgggcaacagagcaagacccccatttttttttcttcagatggagtcttactctgccacccaggctggagtgcagtggggcgatctcggctcactgcaacctccacctcttgggttcaagcgattctcctgcctcagcctcccgagtagctgggattacaggcgtgcaccaccaggcctggctaatttttgtttttttagtagggacggagtttcaccatgttggccaggctggtctcaaattcctgacctcatgtgatctgcctgcctcagcctcccaaagtgctgggactacaggcgtgagctactcaggaggctgaggcaggagagtggcgtgaaccggggaggcggagcttgcagtgagctgagatcgcgccactgcactccagcctgggcgacagagcgagactctgtctcaaaaaataaattaataaaaaataaatttttaaaggaagggagagaggcagggtgagaggaagaggccctgcacccgccgtcccctgcagcagccactgcagggaggactctgctgaaggaggcccaggggctgcagggccagggcccaaggctgacagctccctcccaggcacacacagaggggccgctcattcccattacacaaataaggacacccctgatgtgggagagtgatggctcccaggttgtctacccaagtgggccatgtctgcaggaggcggacctttcgctaatctgaacaaaggcctccctttctccttccatccagaggtggggttgtttgcctaaagtcacacagcagtaaatcacgggctgggatttaaatacagactgcctgctcaggaatccttgttttacccattcagtatcttatatggcttgtggacatgcatatgtgtgtttggacacacacctacacacccccacacacacacaaacacgcacacacacagtggcagctgctcccccagactcaagaacccctgcatctgtctccagggccctccgagacctggggccgcaacagttgtgtctggtttgcagcccagctgagagcggataatcccaaatctctcagactccattccagcccccatcagcccactccccagctgtgcatctttgggcaaatggagcccctctctgagcctcagggtctttgccaccccagcacccccgcacaccaggactttactaggggttctgtgagctgaggctgctttgtgatttatctgagcagagcttcagtgggacacagagaccaccacacgcagctggtgtccatgcagcctggccggctggtagggctcagtggcctcccagggtccctgtttggccaggcttcagggtctggtgtgtatgatttcataggaagcaatgaccttgggcaaaaatgtcacagggcatcagcctaatggattcggcctggctgacagtgagcaggagggttggagtcctcctcctggggctgggttcttcagggtgggggaactcagggatctgggtcattgcctgtggtcagggtgaggagacagaggcccaggggccagcagccttcccagggtcacccagcactgcctgacctcttccaccaccttggggcctttgggaaggacagggtcggtgggggtagaggaacctgcaggggccaacagaccttctcctggcaagtcattgatgcctcagtttcctcttctgtaagatcggtttgattaatagttccgatctcagggctgggggagagtccatgaattgctttataatgagctcagcatagagaaggtgctcattacgtctttttttttttttttctttttgagatggagtctcactttgttgcccaggctggagtgcagtggtgcgatcttggctcactacaacctctgcctcccagattcaagcgattctccttcctcagcctcctgagtagctgggattacaggcatgcgccaccacacccggctaacttttgtatttttagtagagatggggtttcgccatgttggccaggctgatctcaaactcctgaccttaggtgatctgcctgtcttggcctcccaaagtgctgggattacaggcgtgagccactgcgcccggccgctcgttaagtcttgactgtcattcttggtttgcctcacatctctgaccccatctggaacgctctgtacttagcactggttgctgggtgctgccagtcctgggttcagatcccagctctggtgggtcaccctgagctagtgacagagactcttggagcctcagtgtcctcatctgtgaaatggggccaccaacactaccaaggaatggttgggagcaaagtgagatggtggctgtgaggcacttcaggcacctcagctcatcagggtaagtaaagtcctctgttgaccttgccaggctagaagtagctaatttatcgtcatggtgggtggcagaggggcagctaaggccactggctcaaggtcacagggatcagagtggaatctcactttgtggctcaaagctgtgtgatcttgggcaagccacttggcctttctgggcctcagtttcatcctgttgacatcagaagaccccaggaccatacagtggagggctgagtgtaacttggcatccagtcagtgatgtgttttgcacccaatgcctggcacagtgctgcacccaccaggagaggtgggagggtgatggctcccaggtcgtctgcccaggtgggccgtgcctgccggaggggagacttttcctaatctgaacaaaggcctcctttcttccatccacaccctccctgggagtacagcctcacaccttaaactccatttccacaggggccactctggtgcctgtccccaggtcactctggactggccagcctccttgagcccctgatctgagggtctcacaggcatcgtagtttaacacactcccacccagcaccggaaggcccccacaaactggctcttcctgagcctcccctgggctaggccaaaacctgggagtcccccagctcctttccccctcttaccctctcacttctgagtcctgtgggctccctggtctgagcgttctgcattgcatggaagtctaagaggccacaggaaaggcatgcattccggaatcaaggaaatgcgggagctggagtctcattctgttgctatgttgctcaggctggtcttgaactcctggcctcaagtgatcctctcacctcggcctcccaaagtgctggcattataggcacgagccactgtgcccggccactgatcagttcttacctcttctggaacaccaggtccagtgccatcctctgcccctctggtctactgcagtcaactgcctgcttccagcaatgccccgtggtctgttctctgcaggaagctagagggaagctagaggtaaaaacctggagcacatgcgtccctcctctgcaatggttcccatctcccttggagaaaaagatggatctttgaaaggccctgtaggatctgccccaccactacccctcccccaccccatctcctaagcctcctcctccctccctgaccctgtactctgctccagccacactggcctcctggttgtttctccaacaaattaggcatgctcctgcctcacggcatttgcactggctgcttcctctgcaggacacattcttcccccagatgtccacatgcctcactccctcacctcctgcaggtctttgctcaaatgccacttctcaagcatcaggcacctgcccccattccaattttcaatggcacctctgccccaccccatcccctatccccctccctgccttgtttccctctatagcatttatcaccatctcatcttctacatggtttactttttcatctgtttactgtttctccctagtcctttgccctgactgtcaccattcccagaacatccatttcacgagggccgcgttttctgactattttgttccccgctgtgtctgctgggcctagggcagtgctgggcacacggtagctgctcattaaatatctgtggaatgggcagctctggagtgtggataccaacatgcccctggtgaagcgggagctctaggatttggaatcagcctgtaagctgtagagggcagtgccctttggatggcacagccaggtaggcatgttcccagcaggggtttgtgggaaacggctgtggagggtcctggtgtctacagtcagattcccagggcaggatgctgacagatgggccatggcacgatggggaggccaggtggtgtggctgggtccggctttaagcctctggccaccgtgtcaggtttgtaaagcaaagggtcaggaaggcaccaagggcagtgtggccggaagtgaacggcccaggcttctgggaagaaaaagaattacattccaaggaacccatggcttgggcgcctgagccactgggggcagggaagagtatgaaagaggcagggctggcgtgggcagatggtggccttgcctgaggttcagagtggtcaggtctgtaggtcagggtgaccctggagagctgggatttggaccaggtcaggggaagtgtcccccagattgtgaatggctggggcgtggcagccagtccacagctcctgctgctgttgggaggggagacccccactctgggctggggtgcagctcagggagccccggagctgactgagccacttccttgtgccaggcggtgtccatgtccacccccagggcgagatgtgggcaaccaagccaagagagggggctgccaaggccacaagctcatccatgtgtccatttatccatctgtccatttatccatctgtccatttatccatctgtttacagagtgtctattgcatgccatgtgctgcagactcttttttgagacagagtctagctctgttacccaggctggagtgtagtggcatgatctcggctcagtgcaacctccacctcccaggttcaagcgattctcctgcctcagcctcctgagtagctgggattacaggtgcccaccaccatgctcagctaatttttgcatttttagtagagacagggtttcgccatgttggccaggctggtctcgaactcctgacctcaggtgatccacctgcctcggcctcccaaagtgctgggatcacaggtgtgagccactgcgcccagcccctgtgctgtggacttaatgtgataatgtgacttgcatcttaccgcccagggcctctgctcttgctgttctcttggcctggaacaatacctaccagactccagggctggcagctcctcctcacttggggtcacctcctccaagaggccccctgcccactgctgcctgcctgccctctgttcctttacttgggtatgtgctgaacgcctggaaaagaacctagtgcatttccttctttgtctgttgtctaactcccccattcaaatatcagctccacgaagggagggttttgtctcatcactgcatgtccctacacacggtatttggcacacagtaaacactcaatgaatgcttgttgaatgaatgaatggacaaatgaacaaatggaagctctactggggaagctcagggatggagactggctcctaacccagagggaggggatgtcctgggtagcgcagtcctggaagatgcagtcactggtaaactgaagcctaaagaagctcaggcaggcaggtgaagaaaccagggggatggttttgtttcaaaacaccttcctccaagggaggaagaggtgagctacctccaaggttgctcagaggtggaaactgtgattaaaaataaaaaaggcggccaggcatggtggctcatgcctgtaatctcagcactttgggaggccaaggtgggcggatcacctgaggtcaggagtttgagaccagcctgggcaatatggtgaaaccccatctctactaaaaatacaaaaagtagccgggtgtggtggtgcacacctgtagtcccagctacttgggaggctgaggtagaagaatcgcttgaacccgggaggtggaggtagcagagagccgagatagcgccactggactttagcctggcgacagagcaagactccatctcaaaataaataaataaacaaataaggctagaagtggtggctcacgcctgtaattccagcactttgggaggccaagacgggaggatcgcttgaggccaagggttcaagaccagcctgggcaatataatgagaccctggctctacaaaaacaaacaaagcctttaattcattgctaccataaaaatcgagacatttcactacatcctgatgtccctgtctctcttgaagacttggaagatttggccatgtgggccagcattctagaggcaaaggtggtcagtcctgtgttctccacagcccctatcaggtccttgaggtatgtgagcttcaaagccttgtattcacagcatgacccccactacccccacctgctgggtgaccttggacaaccctttctgagtctcagctggtccttggcaaaaaatgggttggaggccaggcatggtggcttacgcctgtaatcccagcactttaggaggccaaggcaggaagatcacttgagcccaggagtttgagaccagccggggcaacacagcgagaccctgtctctactaaaaaaaattttttttttttgagactgagtctcgctcagtcacccaggctgccgtgcggtggcgtgatctcagctcactgcaagctcgcctcccgggttcacgccattctcctgcctcagcctcctgagtagctgggactacaggcacccgccaccacgtccggctaattaaaaaaaaaaatattttttaattggccagtggcctgcacctgtagtcccagctactcaggaggctgaggcaggaggattgcttgaggaggaggttgaggctgcaatgagacttgatcatgccactgcaccccagcctgggtgacagagtgagaccctgtctctaaatgaataaataattagttgggcgtggtggcgcccacttgtagtcccagctacccgggaggctgaggaaggagaatcgcttgaggccaggagttggaggctgcagtgacccgtgatcgcatcactgcactccagcctgggcgacaagagaccctgtcgcaaaaaaaaaaaaaaaaaagaaagaaagaaagaaagaaaaagggttggaagcgcactgggggaaaaagcttgcccactccgctttgggagcctccagcaggctcccgctgtgccaaaggcacacacccagatgtccggtggtccacccctgccccggcggtcacgcctgtcccctcctccagccccagcctcgggtcggctgagagatgacgcgtggcccggcccagccggagcgttggtccctagagcgctagcgccctctgctggccaagggcgggcgtgcaggcccgagccagaacggggaagccgggcgccaggagagcggggaggagcttcactcttctggtcggtgagatggggaagagcaatagcgaatacataagcagaatacaccgaaaggaaaggaaagaacaatagcgaaataacatttacggaggggtgctccgtgccgaggactgcaagaagcccacaccatgtaaaaccacacgtaatccttagaataacccggcgaaatggcaacggaaacgcacagagaggttaaggagccctcccggggccacacagctggtagtggaaacggctgactcctgggcctgcactggcatccaccgaggcggagagaggatgtgaaggtgtcacctccgctcattcactcatgcatggccttccagccagccattcacccattcacaagtattcactgaacacctactgtatgcccaacattgtgtgagatggcaggaacacagccgtgaacacaattggcctcatccctaccctcttgaagctgacattttagtgggggtgggagggggcagataataaacatgaatatatcattaacagctgggccagaggccaaaggataaacctgtatgcgctcgctgatgttactcaggctcctaccccaacatgattttttgccgcatctgagccctacctgtacttttacttgacatttgctcctagataattggtttttacttaagtgtatatatatatgtgtatatctatatctatatctatatctatgtatatgtttatttatttattgagacagagtctcgccgtgttgcccaggctggagtgcagtggcacaatcacggcccactgcaacctccacctcttgggctcaagcgatcctcccacctcagcctcccgagtagctgggactacaggtgtgcaacaccatgcccagctaatttttgtattttttgtagagagggggttttgccgtgttgcccaggctggtctcaaactcctggactcaagtgatctgcccaccttggcttcccagagtgctgggattacaggcatgaaccactgtgccaagacaaagttgctgggttttttttgttgtttgtttgttttttgagatgcagtctcactctgtctcccaggctggagtgcagtggcacaatctcggctcactgcaacctccgtcttccagattcaagtgattctcctgcctcagcctccctagtagctgggattacaggcacgcaccaccatggccagctaatttttgtatttttagtagagtcggggtttcaccatgttggccaggctggtctcaaactccttgacctcaagtgatctgcccacctgggcctccctaagtgctgggattacaggcatgagccaccgtgcccgcctgccgaagggtatttttaaaagggaatttcggcatggtgaaactctgtctctactaaaaatataaaaattagccgggcatggtgttgcgcacctgtagtcccagctacttgggaggctgaggtgggagaatcgcttgaacatgggaggcagaggctgcagtgagccgagatcgcgccactgcactctggcctgggccacagagcgagactccatctcaaaaaaaaaaaagggggggtggtgggaaatctcatatcaccacacctacccaaccagtatcagttgtcacctatcagacagcatcctggactgagggtgaggtattgacatcactgttatattaatcaatgtccttggcatgccacatcagttcccctggttcctggcaggggcactagaatctcccactgggaaccccaagatgaagccagccccagggccaggcctagggaatgaaggtgccatcagcttctgaagaaggtgggtggcctctccaggatcctccaagccactgtggcctgtgctttctctggattctgctggtgaccctgaagaatctgaggcacaggccttccctggccaatcagaaagcagtggcttccatcttagcttcctgcccaccatggacaaccctgggtcgtggaacccccgtctgctctctttcatggctggcaatgggtgtaagggggacttgctcagatctgattctcaaaattcctgccagggaaggccaggcttctgagccagtccatctgttgccccctgacccagccacccagcttccctgcatgcagggcagagggaacaggaggccccacggggccactgggacccctcccttgtcactgccagtggcctcacaggtccatgtgacccaccaagagaggaaggccaggcccagccctgaggagtgattcattcattcagtttacacagtcagactttgtgctggacactgtttgttgttgttgttgttttgttctttgagacagggtctcactctgtcacccaggctggagtgcaatggtgtgatcttggctccatgcaacctccgcctcccgagttcaagtgattctcctgcctcagcctccggagtagctggtattacaggtgtgcaccaccacgcctggctaatttttgtatttttagtagagacggggtttcactatgttggccaggctggtcatgaactcctggcttcagtgatcctcccacctcacctcccaaagtgttgggattacggacttaagccaccgtgcccggcctagacaccattttttattttatttacttatttatttattattattattattattattattttgagacagagttttgctcttgtctcccaggctggagtgcaatggcgcgatctcggttcactgcaacatccgcctcctgtgtccaagtcattctcctgcctcagcctcctgagtagctgggattacaggcacctaccaccacacccagctaattttttgtatttttagtagagacagggtttcaccatgatgatcaggctggtcttgaactcctgacctcaagtgatgcacccgcctctgcctcccaaagtgctgggattataggcgtaagccaccacgccaggcctattattattatattttgagacagagtctggctctgtcacgcaggctggtacaatggcttgatcttggctcactgcaacctccgctacccaggttcaagtgattctcctgtctcagcctcccgagttgctgggattacaagcacgtgccactacgcccagctaatttttgtattgttagtagagatggggtttcaccatgttggccaggctggtctcgaactcctgatctcaggtgatccacccaccttggcctcccaaaatgctgggattacaggcgtgagccactgtgcccagccttcaacactatttttaacactgggttcatggcagtgaagaagccagatgaggcgcccacctgcaagagggacaaaggaataactactgcaatgaatgagatagttaaaatacactgggcatgggagtccaaggcgggtggatcatttgaggtcaggagttcgagaccagcctggccaacatggtgaaaccccgtctaccaaaaatacaaaaattagccgggcgtggtggtgcacgcctgtaatccccagctactcggtaggctgatgcaggagaatcgcttgaaccagggatgcagaagctgcagtgagctgggatcgcagcactgcactccagcctgggtgacagagtgagattctatctaaaaaaagaaaagaaaaagaaaaaaaaaagaggccagctgcagtggttcacgtctgtcatcccagcactttaggagtccaaggcaggcggatcgcctgagttcaggaattcgagaccagtctgaccaacatgatgaaactccatctctactaaaaatacaaaaattagccgggcatggtggcaggcgcctgtaatcccagctactcgggaggctgaggcaggagaatcacttgaacccaggaggcgtaggttgcagtgagccaggatagtgccattgcactccagtctgggcaacagagtgagactctgtctcaaaaataaaataaataaaataaaataataaaataaaataaaatataaaataaataaataaattaattaattaaaataaataaaataaaataaaatatgcctgtatccttggatggagaaacctgctcctagaactgtgttctacagaggtatgcaaatgcacacacatgccctgaggccagcgggcagcagagcagcagagaccacctcaggcccagcagtccaggcctggccaccgtggtggtggcccttcatgtgctgggtgtgctgcgcttaactacggagcggatccccaaggctgctctgcagggcactgggaagaatatcccggggaggagctaagtggagatcacattcccatttgcgtaaaaaagtgggggaagtgcatgaggggagggggaaagaatgcggagtggtgctggctgcacttgcgtttgctcgcgtgctgcctgtgccatctcagaggctcacacactggtgcttgccttgggagaacggggtcagaggtgagactttgccctgcactctattccctttattttctttttgagacggagtctcactgtgtcacccaggctggagtgcggtggtgcaagcccagttcactgcagcctccatctcccaggttcaagcgattctcctgcctcagcctcccgagtagctgggattacaggcgtctgccaccatgcctggctaatttttgtatttttagtagagacggagtttcatcatattggtcagactggtctcgaactcctgaactcaggtgatctgcccgcctcggcctcctaaagtgctgggatgacagacgtgaaccactgcacccggcctctttttttgtttgtttttcttttctttgtttagacagaatctcactctgtcacccaggctggagtgcagtggtgtgatcccagctcactgcagcttctgcatccctggttcaagcaattctcctgcctcagcctaccgagtagctgggattacaggcgtgcaccaccatgcccggctaatttttatatttttggtagacggggtttcaccatgttgcccagcctggtctcaaacttgttggctcaacggatctgccagccttggcctccgaaagtgctaagattataggcatgagccactgcctctggccaactctgttaattgacacataaatgtagggagacttcacgtacaaatctgccttcacagcttccttggaaaatcagaaagatctggcattcactcagcccatgtgcccagtacttagtaacaccttcacactcacctgtccccacccagctgcataacatcagacacatatcagaaccccaaggatgtggcccgtgtcttcttctcacagtgacagggccaccagcagcaatgaggtggctctagcctaaggtctcctctctcccaaggtcaccttggcccgtgtgtgacagctgactgcatctagcaggtgaccttgcccaggtctcacaaggaagtctttgaggttgatctgttatcttctggagctcagagctctgtacaatccacccaccccagcagcttgtttcttgcaaactggaaagaatgaagctttcacaagctgcctttttttttttttttttttgagactgagtttcactcttgttgcccagactagagtacaatggcgtgatctcggctcgccacaacctccacctcccaggttcaagtgattctcctgcctcagcctcctgagtagctgggattacaggcatgtgccaccacacccagctaattttgtatttttagtagagatgggatttctccgtgttggtcaggctggtctcaaactcccgacctcaggtgatctgcctgccttggcctcccaaagtgctgggattacaggcgtgagccactgagcccagccaagctgcctcttcttaaaggaatttcctcctctgccaagtaaggaaatccctaatgctgtatcttgaactttgtcatgaggctccgtgatgaaggagtgacgtcaagaagggacaggccaagagagggaatgtgactgtccctgggctccctaaggttctctgaggggaggtgcaagaggccaggcaggggccgggtgcggtggctcatgcctgcaatcccagcactttgggaggccgaggcgggcggatcacctaaggttgggagttcgagaccagcctgaccaacatggagaaaccccgtctctaataaaaatacaaaattagccaggcatggtggtgcatgcctgtaatctcagctactcgggaggctgaggcaggagaatatcttgaacccaggacgcagaggttgcagtgagccgagatcatgccattgtactccagcctgggcaacaagattgaaactccgtctaaaaaaaaaggccaagcagggatccacaggcagggtggaaaggggcacagaggcaggggccgctccgtttatgtgacgccatccacatcgttatgcaacaccacagctaaaggtgcagtacagccaacagtgctcccacccagagggccggagaactttctccagtggagatgcagtccaaggaactggctcttgccccaagaccagagtcagtcagagatccagggcagtggggccccatggctggcttgctgttggtcagccagaaggggtgctttctacacctgctgtctccccgacctttgtcaggtaacgacagatgtttccccacaccacaagtttccacacagtgaaaattaccagtggatgcatcccctccggtacacaaacctggcaggggctggagaccagaggtgtgacccagggaaaccacctggcaaaagtggcaacatctggccaggcgcggtggctcacggcactttgggaggctgaggggggcagatcatctgaggtcaggagttcaagaccagcctggccaacatggtaaaaccctgtctctactaaaaatacaaaaaattagtttggcgtggtggcgcatgcctgtagtcccagctactcagaaagctgaggcagaattgcttgaatccaagaggtggaggttgcagtgagccaagaccactccactgcactccaacttgggcgacagagagagattccgtctcggaaaaaaaacaaaaacaaaaacgtggcaacatctgaacctcagacaagcacttcctgtgtgccctaggcttaaactctgtccataaactttagaccatctgtaaacccaccaccaaggaagagcaaattacacaaacgtgggacacagtgcccacaagatcacagatccaaacaactgtctcagagggttttgagtgttgtttcacaggccttaagcccaggtccacccagcccgcatcccctctggtatataaacctggcaggggctggggaccggaggtgtgacccagggaagccaggtaaagtgcacactctaggatttgagacaggatttgttttcctcttgggggtaactcagcacagaagaggccacctttagatttaaccacgaatttgttctggggttttccagcagcattttattatttatttattttttgagacggagtctcactctgtcgcccaggctggagtgcagtggcacgatcttggctcactgcaagctccacctcccgggttcacgtcattctcctgcctcagcctccggcgtagctgggactacaggtgcccgccaccacgcccggctaattttttgtatttttagtagagatggggtttcactgtgttagccaggatggtctcgatctcctgacctcgtgatccaccagcctcagcctcccaaagtgctgggattacgggtgtgagccaccgcgcccggccattttattttttagagacagggtttccgtctgtcgcccaggctggatgcagtggcaccatcatggctcactgcagcctcgacctctcagattcaagtgatcctcccacctcagcctcctgactagcagggactacaggcgtgcactactaacctttttttttttttttttgagacagtctcgctctgtcgcccaggctggagtgcagtggcgcaatctcggctcactgcaaactctgcctcccgggttcatgccattctcctgcctcagcacctgccaccacacccggctaatcttttatattgttagtagagacagggtttcaccgtgttagccaagatggtctcgatctcctgacctcgtgatctgcccgcctcggcctcccaacatgctgtgattacaggcataagccaccgcgcccggctacactggctaattttttaactttttatagcgacaggggtctcactatgttgctcaggctggtctcaaactcctgggctcaagtgatcctcctgccttggcctcccagtgttaggattacaggagtgggccaccatatctggcctgaaataattttggaacctctcctctcctcccttgggagggctgactgaggatgaagaacccacagctttccctggcccaatgtatgtactttcagaactgaagggcaccagtccctgcagaggactccaaagaccatccaaagaaatctgggcagggctttctggagggtggcctgttgggaagaacctggccctttccttacagccagctcttctcacacctgagctggccccaacagccagagggaatagcctgctcctgccacagggcaccaagatcgtacctgtatgtagttgggactacagcagaagttcaaactctgggtaaaaactagacacgttcccactgcatatgcagtagatggtagacaaatagttaatcatcagatcaaaaaaaaattttttttaaacatcagaaatacatgtgacaatccgatgatttttttttttctctgaatagactactaagtccagccaataaatggcttctagtggaggcttaatagctcaagacctgtgaggctacttaaatcaaaggaagaacgcttttttaaactaccatcttgggctgggcacggtggctcacgcctgtaattccagcactttgggaagccaaggtgggtggatcacctgaggtcaggagttcaagaccagcctgggcaccatagtgaaacccccatctctaccaaaactacaaaaaattagctgggtgtggtggcgggtgcctgtaatcccagctattcgggaggctaaagcagaattgcttgaatctgggaagtggaggttgcagtgagctgagatcgcgccattgcactccagcctgggcaacaagagcaaaactctgtctcaaaacaaaacaaaacaaaaacctaccatctttaggacaggggttggcaaactatgatccatgggccaaatctagcccactgactgattctgtatggcttttagcatgaagaattatttttacagatgaacatttgcaagaggcttgatgacagggaacactaatgagtcccagttaaacaacatgttatctcctaaaagaactccagtcctcacgttagtgggccagtagcattataaataaactgaattccactttgaatttcaccaattaaaaatttgggaaatctgttttctctcagaatataagtacttacacaatgtccttagattttgcctcttggcctgcaaagtctatatatttactaatttaggcccttttagaaagtttgccgacccctgctttaggatgtcaatttgaatcccaaagcatctaaaacattaaattctgtccctaatatgccaagaggaagaaaagtacagcctgttaaatattaacgcacactttttttttattatattaaaatcaggcaatggtctgacaataaaaaggctgcttatggaatactgttatgttaaacttcacttacaggatgttaaatccttagaactaaggttttccccccagaaaaagattaatggaaacatcaattgcttttcagacttgatagttgctgcttcaaaaggtggttttacacaaatactaaattaaaaaaaaaaaaaaaacctttagtacacaatgaattgcttttatttcggtatgcatccacatttcagcatttagtggtcctgaacagcaagtggaaagacgcagcaatttgccaggaggtcaagcccaccaatttcggggatctgctgtgcacaccgggttccttcttaatccctgctgaggatcttgggaagcagcagcagcaccaaaaccaaggcatgcaccggattcaaggttctttttgttccagttgtcagattccaaactagaccccaatggattgcaaggatgaccaaatgaaagccctgtttaaaacttcttcaatttttaaaagcaaaagcagttacaggaaagtaaaacaattcagagggatcatgtgtgcttacaagtatcttcatgcggtctttctccaagttcaaccaccaaggactccgagagctggcaggtctgagtaaccctggtgactattcttttcaccttatcaaaacctgagctaaaaacaatgcatcagctgatgacagcagagggtggcagggctgaggacccaatattcatttcccaggctggtggagagtgagtgagtatggttccaaaactaaacaagggaggtcagaggctctttccaaccttacctgatggcttctggccaaagcaaggaagtgtcatggaaggtgttgggtggtgacggtgcaaaaaggaacttgaggaggagggagaaaaagcagcacccctcgataaaggtgggggagagaagatatggggaaagccctgaattcctcaccgaaggccaatctcagaggggagtggaggggttacaatctatgcttcggccaagggcgggagtggaggagcgtggggacaggatgatggtttggaaggggcatcacttaagacttaaagaaaccaggggtgcaggcgaaacaccccacacacctagcagtagtcccacaggctgcgacctgaaaccttcacatctactctaacaagccccccaggctagagggctgttgttgcagggagggtgggaggcgggagggtaaggggagaaggcagagaccccaggccgtgtaatcagcagcaaggtgattgtgtgatgtgtcttttcacagttgagttagatgtgccccaccagttatgatgggaatcaatttaaatagactttcttgatcccagaagttcaactacgtggacagtggttacacttgacaggatgatttgttatagcacaacttatatatttcaaatggacaaaaaattagtatcatttacagtatcttaagataaatttcctttgaatgggagcttcctttccggtactttgaggtctacaagacgtatctagaaaatttactactgtggaaaatgaagactgattaaatcgaattggggggaaggggaagggcctgtggtttttctttttgattaattgctgtaacactgtccttcgggcggctgagggagtttcatattttctttagacatcattaggcgccgaagctcttgcaggacaactttgatgctatatgaattctgccattttgctagcactgatatggctcttgggtccacctacaacaaggcaaacaaaagcaaattactctcagactctcaaacaaaatagctatatgccggggttaagctaaggtgcaaactggagtaagatgtactttttaagctgaacctgctgctaatcctaataccttacatgcggaatacctacctgctagagtccctccctccagtcagcctgcctttcccttttgtgccctgaaccattactatctgggataaggaaacggtggtactgacacttgggtgagactcaacccagccctacttggctcttcaataatggccgctgctgggctggcggctgccgggctcaggacctgtcctcttcactgcgcccaggtcagggggacagatgtgcatgcagggcagtacggacagccaaggcaaagggtggccaggacacctgctccagtgacaagggcctgccacagagccagcacctctcaggttaaggcagcatttcccaaaataaattccccaaagcacaggttgagctctgggctcaggactttaggtggaactcagattcaggattaaacactaaacacactgtaacaaagctcatctcttttcaattttccagtcttctgagtatctcaaagacgaaggcttggcgtgacgttaacatgtgtagcatcccttcaacacttgctgatctcctctttgaacaggagagcaggcctcaaaggctcaaagcttttggcaaatgacacatggagtcaagatttattaacattgctctgtttttgtaatatttactgttgccattattgcccagttatgacaactgagacaggtttttcatttatggtagtaaaaataaaaaagcaaggccattaaaggaaaaaaatattacatgccagtggttcacaaataaggcccaggggggtaaaggtgtagccctgggaaagatcttccacgtctgtgcctcagtttcctcatctctacctcactggggtggcatgaggaaagagctcatatttcaaagcgaccagcacagaactagcccagggtaagtgctatatgagtgatcgccagatataattgggaaacaggccccatcccaaatctgtgctcctatgcacagtgatacagtttatcaacaaataaccaaagaacctaggaattgggcccagtctaaaagctcctgatgttaagtacaaagcaactgtcaactccaaggaacaagtgggacagagaaaacaacttaccactccattagaactatttactccattcatattaatttttgttacaaatcttacaaaggggggtgcttctgggtatttaggtccacattctattttaaggctgtatattcggttttcataaattgtctggaaaaaaagagtacggagatgtcacgcaattacaaacaaagcattcaaaaaggtagagcttgtgaaaccccatttatccctgactgtagaactggtacatctgcttccagcatggagtctacttgttctgtggtaggtcagcagttctatactagttcctacactagtttatatgacttccgggccttgggggaatacaaagaagatggagcatttaagctagtaccagtgaagtttttagtattaagtctaatcagagggacctgtttttatgttaatttctctactttgcagtccttctctggggaatggtaagaggcattctctattctaggaagccgagttaaatgtccactcaccaggatcatcagccaatcagttaaataacactatgtggtattaaagcacagaacaggtcactgctttagagaacctcaaaattaagacaagacgagggaggggtgcagactcagagctgcttcccccttctccatcactccggggttaggcactgggtaagggatttcaactggggtgttccatccctccctgcagtctttttttttttttttggtagtctgacctgagagattactggcattcaatgggtgaggcagcacagggaaaagcagtcttttttttttttttttttttttgagacagagttttgctcttgttgcccaggctggagtgcaatggtgcgatctcggctcaccgcaacctccgcctcccgggttcaagtgactctcctgtctcctgagtagctgggattacaggcatgtgccaccatggccgggtaattttgtatttttagtagagacagggtttctccatgttggtcaggctggtctcgaactcctgacctcagctgatctgccctcttcggcctcccaaagtgctgggattacaggcatgagccaccgtacccagccaaaaaccgtccttctttaaaaggctaactgtgcctttgttgagaaacactgaaaagtccaaccccctatgccaataacctcttcactgtaccatctaccccataagcagggagatgcgctctgttgcccggctgttccttctgcttggagcgtcctgcccccacctgaaatgccttgcaaccctgaagacccagctcaaacactacctagtccctagctttctatcccatatgaagtcacactgctatcacatgtgtctgaagaccacactgaagggtgatgtctcccagtaaagagtaaccccctcaaaggcaggggctcccctctctgtgggttcccctgtcaggcatcagtgccttctccggcatcagtaccctctccggcatccgtgccctctcctcaggaaaggagtcttgtactgcataattgctcccgtgtaaacagcggcatctagtggtctttggggagaataaatcagaggatgtgatttaaacccttgattcagaaggcattcataatatacccatggaaacttttcttgtccacagggatcccaaactacaaccaaaccaaaactgtgaatttctacctaccctcaacctgccctcttcctcctcagtgaatgacatcagcatctacccagttagctaaagcaaaaactagcaggcaacccaattcccctctcccttaccctctacctgccagtggtcagaaggtcccactgttctacctctgaaagagaccccactgttctacctctgaaagagaccccatatccatccactttcctccaccaccgtcacctcttctgaactcccccaagtctctttctctcttgctcccggcacagcagccagaccaacgtcttaaaaacaggaagctgtctctgctggcttaaccctctgatggctcctagtgacctgaagaggaagccaaagttcccagactgacccgggcagccctaactgcctcttcttttactcttctccctcccctgcccaccattcctcttcaaccttgccaagttctctccaccttggggctctcaccccagctgcttccccttggaagtgttcccgatcccctcagcccctcccaactgaggctcagttatgcatcagacaccctcactaaacacagaaaaaggagggtgggggccttgacaggggccctcaactgaattggtactcaaatgtttgttgaatgtttctcttcacacttttatattataaaataaacacctcattgcaattaaggtgtttcctcaaagaaaaaaaaaacccagtaaacagaacaagtaggaagcaaacaaaggcatgactcacatacagatttatggagaatataacagatccatcctcagaacctatcatagtctccatcaacaactatatactcagtgttgactgaatagatcctgaatggagcaaaaatcatgctccctggttttgtcacacaattcaagaatgaaattccttacattttaaggaatcaaatttctcaccactgatattcatctggtaatttcactggaagacagtaaaaaaaaaagcctcaagtcatcacagacacacacctgaagggtcatttaaaagccccaacctaaggccgggtgagctggctcacgcctgtaatcccagcacttcgggaagccgagacaggcggatcacaaggtcagtagatcgagaccatcctggctaacacggtgaaaccctgtctctactaaaaatacaaaacattagccgggtgtggttgtgggcgcctatagtcccagctacttgtgaggctgaggcaggagaatggcacgaacccgggaggtggagcttgcagtgagccgagattgcgccactgcactccagcctgggcgacagtgcgagactccatctcaaaaacaaaaaacaaaaaacaaaaaaccccaagctaaggctgggtgcggtggatgacgcctgtaatctcggcatctgggggggccgaggtgggtggataacctgaggtcaggagttcgagacccatctggccaacatgatgaaaccctgtctctactaaaaatacaaaaattagccaggcatattggcaggtgcctgtagtcccagctaaccggggggctgagacaggtgaactgcttaaacctgggaggtggaagttgcagtgagccgagactgcaccactccactccagcctgggtgacattgcgacactttgtcaaaaaaaaaaaaaaaaagccccaagctagactttaatagaaaccagggttacagggtttctggtttttttattttgttcatgagtgctccagggacctgctaaaaaggtttcagcaaaggaaatgtgcctgaaggagaattgctggaacattctgcgtctgtgagaaatactgctcttaagattcattatttgatcatgaaacaaacactttccactttgttgatatggctcatgctttgtggagccgtttggcagtgctcatcaacatgtgaaatgggcatgctcagaccagcaggccccttcctagcaatttccttcagagagacgcaaacttgtgcacaaaatgtgaagcactgtctgcaatagcaaaaataactacaatctacatgtctccttgcaagggactatatgaacatggcatattcatataacccggagacttcgtagccttctcaaaggccgagggacactccttgggcacacacacacatacgaaagactggcaaaacatggcaccaggtatagacgatacattgtaggatatgtatagcctataaaagcagacatacactttcttccaattctggatatatttgtgtgcacacaggctactttgtccattaggcactacaggcccagagcctggagattataaatttttcctgggccaaatgcatacatatgagataaccccagtctaatcattaaaaaaaaaaaaaaaaaaagacaaattccaatagagagacagtctacaaaatacctgaccagtactcctcaaaacagccaagggcatcaaaaacaagaaaaacctgagaaatgtcattgccacgaggagccagagatatgatgactaagtgtaatgtggtatcttggatgggattctggaacaaaaaacagatataagtaaaaactaagaacacctgaataaagtatggactttagctaataataatgtatcaacgttggtttattggttgtgacaaatgtaccataataacataagatgctagcaacagggaaaaggtagcacaggaagtactacctttgcaacttttctataagcctgtaagtattagaaaataaaatttgttttaaaaatgtatgagctaggctaggcacggtggcccacgcctgtaatctcagcactttgggaggccaagacaggaggactgcgtgagcccaggagttcaagaccagcctgggcaacaaagtgagaccctgtctctacaaaaagtaaaaaaaaattagccaggtgtggtggtgcgcctgtggtcttggctacttcggaggctgaggcaggaggattacttgatcccaggaggtcaaggctacagtgagctgtgattgtgtcactgaacttcagcctgggtgacagaatgagaccctatctcaaaaaaaaaaaaaaaagtatgagatatgagaaaaggaaaaaggtattaattacaaaaatatgcaaggaaaattacaaaatctaaacatacaaaaaggaaacattaggtcaaccagtcacctgctattcagttccaatcttacatagttatatacaaattacgtttaatgtacaatgtgggtacatgctatgttagaatgcagatcacagtaactgttggggagaagagtggggatatggcagttagggataaatcaggaaaaaagactccacactaggttttataacagaatttaatataagacattgcttaaacaggcgtcagtggactgaaaatgttcaaagggaatctaagctaacacagatgtaataacgaaatgaagcaggatggaaactcttaagggagggggggataagctggagtttaccagggttgagtttaccagggttggaggctaaggaagaggtctgaagagttgaactcagaactctgaggaaggggtgctgcctggctgctgctagaacctccaaggagggggcttggcgggatgtgatgaggctggttttgtgaatgtccccagaaagctggaggttgaaacacactgctgatgccaggatgaagggctgttaccagggtggtacagacagaacaaacaggcaaactggatacagcaaatcccttttcccttccccatgcctttcaggctctctcttgtgtccctgactggtggaaccttcagaggaagccagctgacaaaggaaaagtgtagtgtgcagagtcccagccccagcatccaaagcagagtggagagaagtgggcttggagtttcctagccagcagcagcaggcacctctctgcacagcgacgagacacaattatcctttgtacagagactctccctcttcccaccattcatggtatctttctgagtgagcacggggcccatctctaggcaatagtaagttttcacttctctagttaggttgtagaatatttgggtggcactcaaatattcttaaggactgaatggtcaaattaaccacatgatcctaatagaaaataaaaagtaggaggcatttgacccttcacatttgcttgctgttcctttaggtatcaccccagtatgagccccttacctcggcagcaagagctggttctgggcttcagtgtcttttgcactcccccaaccaggcttgcccctgccccgcaggtgccagcagcagcagagggggcaccttttccccaagtgccaggttctgacagcccaagcttcctctgctggcctcccaaacccagagggtggttactgtttctgcagcagtatctctgtgttctcatattgtgccttctttgattttttagtccaacatctatttgatcaacttcctatattaaattatctctgttgcctagtattgggtatcaatccaaaggaaattaaatcagtatctcaaagagatcatctgcacttccacactcattgcagttattcacaatagccaatatatggaaacaacttaaatgtcctagagaaaatatggcatatatcacacaatgaaatattattcagccataaataagaaatcctgccagtcggagaattgcttgaacctgggaggcgggggctgcagtgagccgagatggcgccactgcactccagcctgggcaacagtgcgagactctgtctcaaaaaaaaaaaaaaaaagaaatcttgctagtcatgacaacatagatgagcctgaaggacattatgctaagtgaaatcagccagacacagaaagacaaaaagtgtatgatctcaattatacatggaatctaaaagtagaactcacagaagcagagaacagaacagtggttgacagggaccagggtgtaaggggagatactggtcaaagggcacaaactttcagttatgagtaagttctgggaatctaatgtaaagcatggtgactacagttaataatactggattgtttacttgaaatttggtaaaagagtagatcttaagtgtccttaccacagacacacaaggtagctacacgtggtgatggatgcgttgattaatttggttgtggtaatcattacacaatgtatatcaaatcatcacactgtataccttggatatatacagcttttatttatcaattacatctcaataaagctgggaaaaaaattagctggtatgatttctcttttcctgactgacacagagttaaagcgggactaagttaacctcttattctatatactctgtattgttggaaaaaaaattttttttgagacaagagtctcactctgtcacccaggttggagtccagtggtatgatcttggcccactgaaacctctgcctcctgggttcaagcgattctccctcctcagcctcttgagtagctgggactacaggcgtgcatcactacgcccagctaatttttgtatttttagtagagatggggtttcaacatgttggccaggctggtctcgactcctgacctcaagtgattcacctgcctcggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcgcgatctcggcttactgcaacctctacctcccaggttcaagtgattctcctgcctcagcctcctgagtcaggcatctgccaccgcgcccagctaatttttatacttttttagtagcgaccgggtttcgccatattggccaggctggtcttgaactcctgacctcaggtgatctgcccgccttggcctcccaaagtgctggaattacaggcgtgagttaccacgccccgcctcaaagcttttaaaaaagagatcagtcaatatgcactgatatagaaagatgtccaccatctattaggtgaaaaaaaattaagttgtaaaacattatgcataggaagatcccatttttcttaaaaagatatatatttacgtttgcatacccacagcaaaagtgggtagaaccacaccacacaccaacttaagtttcattcgatggtgagcataatgaatcagagaaaggatcacttttcttttacttcctacacccctgtaattatgttcagttcctctgaagcatgggtaccagtactccagggtataaacacacatccaggctctaatccacacataaaacacttggccgggtgtggtgggctcatgcctgtaatcccagcactttgagagaccaaggtgggcggatcacctgaggtcaggagtctgagaccagcctggccaacacggcaaaaacctgtctctactaaaaatataaaaattagccgggtgtggtggtatgtgcctataaccccagcgactagggaggctgaggcaggagaatcgcttgaacccgggagacagagactgccgtgagctgaaatcacgccactgcactccaccctgggcaacagaataagactccatctcaaaaaaacagaaaaaacactattttggagaaccccagaggctcaacagtgctcctcgatgagggccatttttgcccctctgctgggaaggggaagggaggatcaagcgttgcctagacacatttatggttgctgcaatggagacgggggtactgctggcttctagtgagtagaggccagggatgctgctaaacagcctacaacgcacatacctagcactctcatgacaaagaaaagaaccagccctacatgccacgtctgagaaactctgctctatataacttgactattgttagtacttctgtggtcaaagtagaaatattccatgtctaacgctgtggacagctagacatttgccagaattgtgcaaggagcagttggctcagaagctttgtttttaggtttggaggatttgcttttctttaaataaacaaacaaacaaaaaaggtgggggcactattcaaacagcacacacatatgactaaaacattcaaagagtacagaagggtatatggtaaaaagtaagtttcctttccactccagccctagccagccagctcccttctgaagaagacaaccactgtcagcagcttctttcccattcctccagaggtattctaagcacacagaagcagtgtatgcatgagctcttcctctgcacccaaggccccccactccaactggcagcatactctgtctcctgttttataatttactttttcacaatatcatggagatcattccatttcagcacacataaatctgtctcattgttcaacagctaaacaggacataatatggtatactcaaagacaatgatgttgtttccaatattttgctactactgacaatgctgcatgaaataattttgtacactgcctttgggcaatacattcaagagaaattggaaagtaaattcctagaagaattcctggatcacatggtatagacctttgaaattttgatggaaaatgttcttttgagtaaaacaataacaaaaacctaatagggagatgagttactcaagtgctctatttagatgctttaataattatgtggatattcgagttacacagcaaatagctcatgtgctaatcatgaaagattggtcacaggaagcatctacacacagatagttccttttatgacttagtttctgaccttggggaaccaggataataaaaactacaagggtgaaaagacaataacaagtgttggtgagaatgtggagaaatgggaactttcgggcattgctagtaggaatgtaaaatggtgcagccactttgggaaacagtttggcatttcctccaaatgttaaacacagttaccatatgatccagcaattccactcctaggtatacacccaggggaattcaaaaatgtatctccggcagggcgcgatggctcacacctgtaattccagcactttgggaggccgaggtgggtagatcatgaggtcaggagttcaagaccagcctggctaagatggtgaaaccccgtctctactaaaaatacaaaattagctgggcgtggtggcgggtacctgtaatcccagctactcgggaggctgaggcagagaattgcttgaatccgggaggtggaggttgcagtgagccgagattgcgccactgcactccagcctgggagacagagcgagactccaactcaaaaaaaaaaaaaaaaaaaaaaaaataataataataataataataaaatatatatatataaaatatattatgtatgttatatatataatatatataggcttggaggatttgcttttatttaaataaaaatatattatatattataattatatatcttatatataattatatgtaatatatattacatatcatatatgttatataaatatacagtatatataatatataacatatgcattatataatatataatgcattatataatatataatgcattatataatatataatgcattatataatatataattatatataatatatgtccatcttcaaaggaggaaaaattaggtagctaaaaacaactatgtccatctattccagcaggtgtagataaaaaaataaaaagaaaatatatgtccacatacaaacctgtatataaatgttcctagaagcattatttataatagccaaaaggtagaaacaacccaaatgttcatcaacaaatggaaaaacaaaatatggcgtatctgtacaatggaatattattcagccataagaagaataaaagtattgatagatgctacaatatgcttgaaccttgaaaaaattatgctgagtaaaggaagccagtcacaaaaggccacatactgtagaattccatttataatagatgttcagaaaaagcaaattcattgagctagaaagtagactgatgattgtcaaagatgggaaatgggggatgtgggagggagaatggggggtgcctaccgatgggtatgggttcctttttgaggtgatgaaaacgttctgaaattagtgacggatgcacaactctgaatgtaagaccaccgaactgtatatttaaaagggtgaattctatcccaataaagctgttaccaaaaacaaatacatggaggactcctggcataccgtagctacgcattacaacttccaaagcctcttttggaaagagataaactgaaattcagggtagcccaagctgttttaggcagacagaatattttcagcagaatttactgatgcattgttttgtgtgtttttttgaaagtgtacaattcagtggtatttagtgtatcgcaatgttgtacattggttcaattctcagtattttagaacctgtaaatcagtaagttgattaacaaatctactgagtaccccattctgagtcatttctaggtattctgggaagtaaggagggaagcacagttctcatcctcaagaaaccgaaatcattcttaggaagagaagacatgcagtgaagaagatgtcagcatatgatggaccttcagagacagcaaagaaaattatctccatggagaaacaggatttctagattgggttttccccggtatttagcagacgcagaaaattctggttttcacaggaaaaaaaggataaagaaatgagtaaaaacagatcaaatgtatatatttttaaaactccacaaaactatagggtcacaaaatgacttaagaagcaacattaaatggcaaagccaatcattcaccatgagtgttgatgaccatctgaaatgagcattagtgtcctaacacttaacgaacatgtcacttgtccctgttccagcccgggccacgccctacatgtctttctgctctcacagtgctagtgcagagtcctgcacacaatcaaaagaatgaatgttgtcatcatccttaaacacaagcagacacaggacaggtcttgctacattcaggcagaggcccttactgcttgtctgaagtgtgtgtcacagtatggaaatcaatttcttgactcctacatcaagttactacttgattagtatcttctataatggtaacagatgaaaactcaaaatgtaaacaaaagggagacaccacagcacagtggttaagagcacaggctctggagtcagatctggtttgggggttaccagctatgtgactttgggcaagagatctgactcctctgagtctgtctcctcatctgtgaaatggaatgcaattgcacctaacaatggggtcttgtgagagttaagagacatttcttgagggtttactatgtgtcctcaaaaaacggttggctggcattatgaagactgggaactctcacaaatcaggaaggtctgaaagaggccacttttccccatcctcattgtcttcgtcttctttgcaaaggcctctgggtctagtagtgcctggaatagaccaggagctgacaggcttgccagggacctttgctgaatggcccaaggaactaggatacaggtgcacggcagacctgggagacagtgaagaaaaaccacaactgggaaggctttccagagttaatttggagactggcttcaggaatgctggctatacctagggcctagttatttggttagcccagagattgttctgaacgacatctgatggtgcaatgacttcacacctcactgtctacattgtcatataaattcacactatgagtctaaacaggtttttgcttaccatttagaggggttaaacagcatcagagggggttcaaatatataaactgaaactggtcaaaaaagaatagccacatttcagaaaatataccattggtgagctttttttccgtgataaggctaatattttttaaaaggaggcacagtgaatttaagacattgacatttatagccgtagctcgacgcttactcttggaggcccaattatcatccctgtccatcttgtaagtgtcatgtcttcgtcatcttctagaccccagctaactgtgccatctcctactcctttctggccttcttcgagttcttccaacagtcggaaattgcgagggacttttactcctaaaataaatggaaagaaattcaagataccagcaactccaggggaacttgtaagcctagagctagctgctcattatctctccctgggaatcaagatgctaacatgcaaaaaaatcacggaaagttatcacacctcaaacttgctacttataaagctatcagtatcaaccagcacaaccagagggaaggggcacatggttctctgacaggtgaagtgactagggctagataaccaaacttagaaagataccccacccctaccccttggacaaacctcctaaggggcttacatgtctaaatgtctatgaattggggtcaactagtatgagatgaaaaccatcaatatcaggtgctaacaaaagtaccttggaagacaagaggctaagactacgcttatttgttggcatgactctcaaacaacctttaggaggaatagtcaccatggatatgggaaataaaaatggtatcctcttaatcaactaagagtcaactgaaggcaccaaggataaaatattctattgtttttcaattatttaagtgatagtttctcttttaacttacaaaaaagctaaaagggaatagctggttctcaattgttttccaaaaatcccaaagcctggcaagtagctcttgaaagcaacgcatgaaaacacctcacaggttcaagccacagtaccgggttcaggctgaggcttgagccatttctaggtgtcttccagaacagaacctaggtactggggccagacaagggagggggctatgggaggagagagagatggactttccttctgtgcttggggaacaaatcatctctcctagggttgcactcccaaccaatcctgactgtctctccttcctccattttccctggcatatgcactattttctctggaaaaaactcaggatccagtcaagtttcaagttctctgccttgaatgctgagctctcaattggccagactctcagagacaaacaggactaaccatgtgactgtgaagagaggctcactggagggaccccagattgtgggaggtgttgccagtatatgtatttcccaaagtgtaggacacacgccattaattcaattggaataaatatttgagtacttagtatacatcggggacttttctaagcactgaagaacaagcagtgaataaaacaaaaatgcctgcagcttacattctagtagaagacatataatggacaaaaatgaatatgtaaattatacagtatgacagatcctggtgttccggaggagggagtaatacgggaggggctatacttttaaatggagggataaaggaaaagtgttattgcaatcaggtgtcataactaaagacctaaagaaggtgagagggcatgatttatggatagctgaggagaaagtctttgagacagagcaaacaagtgcaaaggccctaaaatagaggctgcttagggtgtcaaaggacagcaaggaggccaatttagctcaaaccaagtgaggaagatgagagagcaagaggagattaaggatgccaactgttactgagtgacatgatctgtcttgtttttaataggatccctcagactgctgtgtgaggatgagagtgaagggagcaagggcagaagcagctaggaggctactgcaataatcctagcaaaagataatacccgtttggaccagggtgatagcaggaaagtagtgaggagtggcgtaattctaggcatttcagaggtctgagctgtggagatttgctatcaggttgcctgtgaggtgtgagagacaagagtcaactacagctcccaggtttttggtccaagcaactgaaggacagagttggtagtggtatgttagaggactttcggtggtatgtgattgaacacttcgttttacagtcacgtatttatgtttaagaataacttatttagggtaagtaatatactaacttcccatttataataatggtaaaagtttcctttaaaataaatgtaagcaaaagagtcagttgattacaagaaaaatattaaatagtactacatatggtatttgaaaggaaacagcaaaacctgcaagcatacttgaactgcttgtttggaaaacactggcattttcatctgcacagcagccaactggattattcagctatactggattaagtctcctgtagcaaacataaaactgaaagatagtggtgacattataggcaaaaagccagacaacacaactattgttcagaaagggttcaatctaaatctttaataatcctaattaggctagcgggggaaaagtcactacattactactggttaatttacaagcctgcactaataaaaatgaacatcaaaagaatcatattgataggaaggctgatgactgaggtacttgttcacagatcgtgctatgggctgggctgaactgtgttcccctcaaatttatatacttaagtcctaactcccagtacctcagaatgtgacaaaacctgctgacaccttgatcttgggcttctggtctctagagctgtgagaaatttgttgtttaagccccacccagtctatggtattttgttatgacagcactagcaaactcatatagatgataagtgacatcttaaggagctttatagagttggtaaggatacagaacaagatgttaacagctgttatctctgggtaaaagaattatggatgattccccctactttctctatttcctgatttttttacaacaatcccatgttatttgcataacaaaaaaccaattaggaaccatttcaactgcacccccacgcaaggacctacccagggcctgtgcgactgtcattcctgctgtccagaaggctccttcccctaggaatccataagccaagctccctcagcttctttagggctttggttgtccagcacttcatctcaataaggatcaagggttcttctctgagtaggaatctcacttaacggcattccttaagtgactaacttttaatggacaatgattttaatgttactaaaacttggtcagctgggtatggcagctcacacctgtaatcccagcactttgagaggccaagacaatcgtctgaggccaggagttcgagatcagcctgggcaacatggagaaatctcatgtctacaaaaaaatacaagaattagctgggcatggtggtgcccacctgtagtcctagttactcaggaggctgagaggggagggtcacttgagccaggaaggcggaggttgcagtgaggcgagactgcaccactgcactccagcctgggcgacagagtgagaccctgtctcaaaaaccaaaaataaacaaaaaataataaataaattagctgggtgtggtggtgcacacctgtagtcccagctgcttaggaggctgagacaggaggactgcttgagcctggaaggtcaagtctgtagtgagctatgatcacgccactgcattccagcctgggcaacagagcaagaacctgtctctatttaaaaaaaaaaaaaaaaaaaagacggggcgcggtggctcacacctgtaattccagcactttgggaggccgaggtgggtggatcatgaggtcaagagttcaagatcagcctggctagtatgatgaaactccgtctctactaaaaatacaaaattagccgggcgtggtggtgtgcacctgtagtcccagctactcgggaggctgaggcagaaaaattgcttgaaccctggaggcagaggttgcagtgagctgaggttgcaccactgcactccagcctgagtgacagagcaagactccatctccaaaaaaaaaaaagtgttaagactgtcaaataaatggcaaagtataacagcttctacagttaagcccttcattactgaatggaagctgtattacacaagtgacctctattttgagttgctctttttggcaagacaaaaaaatgtgttagtttcttatgtcaggtatttaaatgtcagctggactatttatagtaggactattcctcttgcaaacttaagcaaagaacttctctatggctgaaaggttaccttttcacctaacaatcagatctgattaggaaatcctaacattcaaatatcacaagcttgttgctattagtttcaaaacagtgaattcaagttataattttctgatatttaatttttacttgtgaagtagggcaaaatatattagtaattaatcctatacttccaacatacatttctactggattagatattcgattacttaaaaacaagtgtgcaaagcccacacatacaactgaaccaaagaaataagtcaggtcaatttattttaggctaggatttggaacaggaattgagacccacagagggaaaggtcagctttcttttgttcctgcattataggacaatttgattctgactcaagttgtaaagccagcaccagaaacagtttaataaatgaaaaactttggactggccaatatctatctgtattgcaactaggagttgtgatatacatataaatatctataactgctatctactgaacaattacaataaacatttatttcatttgaacagcagttctcaaaccttttgctctcaagaatgctttatactctcaaaatcattgaagacctcaaagaactttttttttttttttttttgagacaaagtctcgctcttgttccctaggctggagtgcaatgacgcaatctcagctcactgcaacctctgcctcctaggttcaagcaattctcatgatgtttaatgtgtatagaactggacttcacatttataagcaaaaaaaaaaaaaaaaaaaaaaaaattttacacatttcaggaccacagtgaaaaaaagtttgcttggctttttacctgcttgtcaaaatttccctatacataaattatcagtaacatataggcacacacaccttctctcagtgtgatagttatccaatacctatccagcactttgctagacaatctaggggctatgaacaaaataaaaactggggtctccctaacacagtctaaggtgtcagtgtggaaacaagatatacacaaagggcaatgaaataaaaccatatcaaagcacgagaaacagaacctaccagaggacactgttacttagcctttgagggctcacagccttctctgaaatctgacaaaagatgaagaggttggagccatgttactactggactttaccttaagggtaatcggggggagctgcaaaaggctcagagtagggcaagagataaggcatatccaagtctcctaggtaatgatcagctttggggtgtgctactgctaacgtctcaggatatagagccagaagcatttgcctagagcaaacactgtgaccgaacatgtggcatcaaacttcttataggcctgcgtgatgggaagtagaagagatgtagaagatagggtaattaattcaacagctcatattcatttgcatgactgtggtggtagttcaaaaaacaacaacaacaaaaaacaaaaaaactggcctgtacccagtacttcagataaatacctgttgaaaattttttaaatcgagtaaaaaaggacaaaaggtctgcaaacctcattttctaaaaaacaaacacaaaagcaaccttgtatgcatccttgcatgttcattgtactctcaccaatgatcttggggtgtcatgacccagaatcactaacgtaaggatacctggtctaccactctgtttttaaaagacaggtcagagtaatggatatattacctcccacatgcgctaccatgcctgactaattttgtatttttagtagagacggggtttttccatgttggtcaggctggtctcgaactcccgacctcaggtgatccgctggcctcagcttcccaaagtgctgggattacaggtgtgagccaccgtgctcggccgacgatcctcttaaaggtaaactaggtgccctcgctctcctaccagaagcctactcttggcctcccgttgcacccgcaatccacccaaacttgtcacctggccgagagagccccacctgcttcgccaacatcattttgtgccactctgccttgctcccccatcctcctccagctacaccagtccttctctaagtttctgaagaggcatccttacatcccgcctttgtatttgtgagtccctcaccctggaattctctgtcccagagctgtgaatggctgactggttcccttgtcctcaaccaagggtctaactgtccattcccttatcttgccttatttttcttcatagtactcattgccactcgacattgtaaatatattcattttcactttattggttgtttcttgtctgtctcccatctgaacataagctccatgagagtaaaacttcatctgttttgttcactgctgaatctccaatgtgtcagggtgttttgccctctagagtaagcacccaaatacttattgaaagaattaatgaatgactaggtattagctaggaacagtatttcagaatgaacaacgctcaatgtcacaaaattctaatctggtttatttttgaaaatacaagagagaaacattcacagcaccattatctgggagtctaacattataaggattattaaaggggcttagtatgaattttaaagcctaagaacagttatatattaagaggcagagtcccactctgttacccaggctggagtgcagtggtgtgattttggctcgctgcaacctcggtctcctgtgttgaagtgtttcttgcacctcagcctcccaagtagctgggattacaggcgcctgccaccacgcccagctaatttttgcattttcagtagagacggggttttaccatgttggctaggctggtctcaaactcctggcctcaagtgatctgcccgccttggcctcccaaggtgctgggattacaggcatcagccattgcacccggcctgactataataattttaaaagctataaagcttaattagaagccaggcagtcaggagaggccctctcagagaccccggtcccggtcccaaacacctttacttccacacaggcatgtgtggtatgttttctttacatttgattttcttccttttttattgtctgactcactctctaagtttctcaagtcagagctgtgactcattcaatcccgcctccccagaatctggtatgctgtctggcatataatgatactcaatatcaataaatgtttgctggttgaagaaatggcagtatcaggccaggcgtggtggctcatgcctgtaatcccagcactttggaaggctgagacaggcggatcacgaggtcaggagatcgagatcatcctggccaacgtggtgaaaccctgtctctactaaaaatacaaaaattagctgggcgtggtggtgcgcgcctgtaatcccagctactcgagaggctgaggcaggagaattgcttgaacctgggaggcggaggttacagtgagccgagatcgcgccacggcactccagcctggcaatagggccagactccgtctcaaaaaaaaaaaaaaaaaaggcagtatttcctattgtaaactctaatctactgggtccaaaatattggacactgttgccatataattaacatacctggctgggcgcggtggctcacgcctataatcccagcactttgggaggccgaggcgggcggatcacgaggtcaggagatcgagaccatcctggctaacacggtgaaaccccgtctctactaaaaatacaaaaaattagccgggcaaggtggcggctgcctgtagtcccagctactcgggaggctgaggcaagagaatggcgtgaaccccagggggcggagcctgcagtgagccgagattgcgccactgcactccagccagggcgacagtgagactctggcacaaaaaaaaaaaaaaaaaaaaaattaacatacctaaggttttttattttgagataagtaaaatttggtaaccatttctaatttatttttagagatggagtctcactctgtcacccaggctggagtgcaatggcgcaatctcggctcacttcaaccttcaccttctgggttcaagcgattctcccgcctcagcctcccgagtggctgggattacaggcacgcgccacgacacccagttaattctcatatgtttagtagagacggggtttcaccatgttggccaggctggtctcagactcctgacctcaagtgatccacctgcctcagcctcccaaagtgctgggattacaggcatgagccaccacacccagcctagttttatttttaataaatgagaattttaggaaaacttaccattttttttaaaataagggaaaactggtttctcacccaaatcacataagtcaaagaattcttcactataaaatgaactttgtttcataaagtatgtatgaaagcaagttactaatatttcaaaccatttaaaaactgcatacaaagttacatcaatattttctacaaaacaaaagagcatttaattccaaatggcctaatcacaccctagttatagaattcagggtctactccagggacataagtccaaatatggttggaattcagagatcctgcagacttcaggatgtatcagtgacaagcgaaaagctcatcctatcctaaatagagtttaaattcaaaatcacggtacattaaacaaaacattttagtgaatatattaaaaaattaaacgtacatatgccaaagaacagaagcacaacagatgagaaaacccaagaatactctaacatatgttttggtcctctagcactttaatcaattgaatcaacataaaattttaggattcccaatatttctgtgtgaatctgacaccaaaaaggcagctggagaaacagcatcaagtgacaatatggaagacataaaaatggactcttacaggccaggcgcagtggctcacacctgtaatctcagtactttgagaggccgaggtgggagtttgagaccagcctggccaacatggtgaaaccccatctctattaaaaatacaaaaattagccagttgtggtggcacatgcctgcaatcccagctaattgggaggctgaggcatgacaatcacttgaacccgggaggtggaggtttcagtgagctgcgatcatgccactgcagcccagcctgggcaacagagactcgtcaaaaaaaacaaaaaacaaaaaaacaaaaaaacaaaaaacaaacaaacaaaaggactcttataatcttgcaaaaccaagagaactacaggctctataatagctaggaagtacactaggaaaatctatagctaatgataagtataatcaaatagactatgactattaaaaagtgaattatgaaaatgctaaaaaaaaaaacttcatcaaggtgctaaaatatcacagtaatccaagactttttgaagaaaatatttgttcctattatttcagaattattctttccagaaggctttttcctggacctgtgtcagtatcaaaagtcagccggttattctcttagctaaatataaactgaaaagacagcagttgcaggatattacaaagaaaatatggcaaccaggttgaaaaagcatgaatatttgatagagctttacaccatgccacagtaaaacatttaatgcagtaatctgaaacacagcaacatattaatatatttgtggtacaaaaaggattctgaagtcgtttaaaacatcttttgggaaaatcatggccaccaagcagcagctaccacagcatgtcaatcttggaaaaccctggcctaggtcttgaattaaaatggtagagctggctgggcgtggtggctcacacctgtaatcccaacactttgggaggcagagatgggtggatcacctgaggtcgggagttcgagaacagcctgaccaagatggagaaaccccgtctccactaaaaatacaaaattagctgggcgtggtggcgcatgcctgtaatcgagctactcagggggctgaggcaggagaatcacttgaacctgaacctgggaggcagaggttgcggtgagccaagatagcaccattgcactccagcctgggcaacaagagtgaaactctgtttcaaaaccaaaaacaacaacaacaacaacaacaacaacaacaaaaaaaaaaaaacaaaaaaaaggtagaacctcagaggtttctcctgaaaagaaagctgctagttaaaaatggtttggttgcccattcagggaagacagtgaactgagctaggaatctgatgctgctcccacttcagaaaatgaggaggtatggaaggtgatgcactgggattcaacgtccctgaaaactggacatagagccataagcaagtaacttttatttctgagcaaccgcccaagtgtagtctggctgtctagttagcctgcccaggagatctgttcttctccttctctagagcaatggttctccaagttagtccccagacctcatcgcaaactcgctagaaatgtacattctcaggtcttcagcccagaattcctgaatctgaaactccaaggttgggcctaagaatctgacaagccctccaggactctgaggtatactagtttgagatccattgctctaggggaattctagggaaagaattagtagcaagctgtcattctttacagtccagccacgtgacaacagctagtgacagaatgcaagaccctgtgttctgctgctagggtcagtgaccaagaccaagcatcagattttctttgacaaagggggaaacaagatgtgggaaatgagtcaggacaactggagaaggggaggatggttaattctacgatcaagtacctctataaataccaccaaataaggataagagtttcagttttttgaaaggctgaatagccacttttgcttctgccctatcggatacattgtttctccacaaattgtcaaatgtatccatttggctacatcaaagagattctgaattaactcactgcaacattcacaaatatttactgagtacctactattttgtccagaactgtgctggtgctagggacacaacagaagttgagatagaatcttgccctagtgaaaaggcatagaaaatatgcaacgaaacaacacttcaggtaaggttaagtgctttagagaaacagaacaaaacaagaagctgtgacaatgactaaaaaactattgaatggagtgctcagggacggcctttctgggtagctgcgacctgaagaacagcagtcaggcccatgaagatctggggacagagcaagatcagaggtgtgtgacaccacatgaagtcaaggcggcagggccttgtgggccatggaaaagggatgggttattctgtaataagagcagtgggaagggcttgctgaaggggagtggcagtttctattttacgtctgtgaaagatcattctgtctcctgtatagaaaatggaaagggcaagactgaaagcaagaggctttttccatcttccaggcaagagaaagacggttctggttagattaggatgacaagagtggagacagaaaggaggatttggcatttagtttggggttacacctactggacttgtgacagggtggatgtgaagatgaggaaagactactacttgagaggtcactgccatctacccatgaataagctaatcagccaaggcagaaataacagacatgccaatggctgaagatgcttgcgaggcctacctcagagaataagaaatgggggctggaagaacgatcatccggccaagagcacgtgtcctgaagcaacaccatcccagagcacccaggctctgcacctcaggctagtcactcctctcctggcctgtttcctcaccttcacaatcgatacctgcctcaatgggctgttgtgacaagtgagataatgtagttaatacagtgtctagcacttagtaaacccaagagtgcaacttaaaaagaagtctgatggcttgcatgtaaataaggatgaggtactactttgtacctgccatgatggggctccaagcccaagaggtgtgagtcattcagtataaaatataagcaagagcttcctgaaaaaaggacctcactctccttggacagcacataacccagaagaggacaaacagtggccagagatgctataaaaagggttcctgaaacgggtagcagtagacacttcttactaaagccctttctctctccaagattaaacactccaagacttaggaagaacatatccctaaatccatgccttttccatttcctgcaggctggtgagggaacaggagttaaaaatgcctgggctctagtccgagcatcaccagtctcccttggcttttggctcctccctcagtaatgtgggtggatactgcccctggctggtgaccaggctgtggagagttagatgagacaacatcacaggtaagtcgaagtctatgggacactctaaagcactatccacaatacaacagtaatagtattcaaacatttactttgccaaatgtgctgctctgaacttcactgtgccccttcaaaattaagcagaggattcctgacttcatattttgtattctacttttaccaaattactgcagagctacaatttgtggggaggtgggagggatagagatatgaagagaaaagagaatgtggtgggggaaatagagtggttttcagttaacatgaagggggaaaatcatgatcatcaaaattaaccttggtaatcccttaagaaaataatagcttgcagcccggcacggtgacttacgcctgtaatcccaggactttgggaggctgagacgggcggatcatgaggtcaggagtttgagaccagactgaccaacatggtgaaaccctgtctctactaaaaatacaaaaattagccaggcgtggtggcgcgtgcctgtgatcccagctactcaggaggctgaggcaggagaatcgcttgaacctgggaagcagaggttacagtgagccaagatcacgccactgcactccagccaggtgacagggcgaaactccgtctcaaaaaaaaaaaaaaaaaaaaagcttgcactagcccaacaaagccagtttcccctccatcactggagcaggctgctatttctttggctgagcacaatatgaagctgttctttgaatgtagggcccatgttgtacaaaaggcacttaattacaattggcataagatgctcacacagtgagacatacaggaactgagaagaactaagggactgtgagttttcatccatttccagctctctctggggaagactcttgaatggaagggaagactaatctctgctgcccacatggttaagtttttataagctgaatgtgcatatgaggccactccgatgtatgcaaatttaaaatcatgccccaccagggcttacccctctggcactcattttctgattaaatgtcagggaagctcgtgggctgctgagtgagaggaagggcctggcaaccaagggccactatttgatgtgctgcaatcctggccaaggcaggaggaagtcacccgtcataacatggggattctgaggatctgtggtgggcttttcacagttccaccctctaagacatatgtagatatcacacattgcagaaccaaaggaagtgggaaggtggtgtagccaaatgctgaaagcagtgaccataaaaaactaagttcagcccttacaggaactcaaaggcttcacagctgtttcctggcaaccggaggcacagattaatcaagagcctcactctaaacctgactaaggaaggcctctgggccctgaccacacctggaagacttctcagggttagaaagcagagaggcctgtacactcattttagtttaccccaagtaaggtctgctttactcttagcaccctgcactcttttcactgcctagggacgaaggtcagatcttatcatactcctctttttaagactcttattcattcattcaacaaatatttactgaatgcctacttcataccagacacttgtttgatggcttcccctcataccatctcaaatccaaagccatgtctctccaactcatctccttaacaagccttgcttgcacatgaaggccttttatcctgttatttcaacatgccaagcagagtcccaccacagggcctttgcactaacagcccactctctctcctgcctgtgacactgtagggttagctctttccattatttgactcagctgaaatgtcactttcctgaccacctctccagacactatcacatcacacaatttcctccatagcacttactgctatctgaaattgtcttatttactccttaacagccttctctccctgacttgaatggaagctcccgaaggatacagactatgtccattttgtttgctatccacgatgggacataataggccctcagtaaatatctgttgaataaacagacaaaagaattttgggaagtccattttagggcacctcaaagcctgtcctatgttatctaaaccatgccaagtgctcttgtattccactagacagcagctgacattttatctgatcaccatagccatttatgaagcactcactttttaactgtcagggtctggagaagttagaaccgggcagctgttaacccagattgtaggtagccaaccgagtgactgcaagcagggctgagctgcaacagcaccttattgctggctaccaccagcacactgggccccttcgtttattacgacccggtaggagtgttattctggtgagaagttttacccagcagtctggcctgactcagaatctctcttctgggagtgcctggggcagcgtcatggtaaatgaattgactcagcactgttccagctgaaaccaaaatcgagtaaaaggattcatggtctccgctattctgcaagaagaccccactgttttaaactcaaaaggcagcagcttgtggtgggtcacttcagtcagatcccccacattcaatttcttttattcccaccccaaccatcaggcaagtatggctccttgagaccgcagagtagcaacatttataaagaattcccctcaccctatttcccatggatcaccaattccttcccaacactgccgctgctgtggccttaaatatgccaatgattgctgtactcaggctggtgtccctgcagccccacagtggggaacactgtggccctgtttgcttcctccatcagagaggtaacccattttcaccccatctgagagaacctccttggccaacttcactgccaggcacctgagggtgcagcctcacccaagagttcccatttcatctattcacctccctactcccatcagccagtggggaacttctgagctgaacccacatatctgtcccaattattaaaggagtcgatgagagtgagcgtctccacagaagagacacttctaggatatgcttccctcactcaattcaaaaagaggagacttttctcctttacaggaaacatctccggaacccgaccttttccactccctcatttcaggggcttccctcagttgaatccccactcccaaagagacatcctcggggctcccaattcatctgttctccctcatccaatatcagaggcttccaccaactgccccactcggaccttgtcccctgaaacctaacttgaagcaatccatctgtatcctcgaacaggagactggtaatgatggggtcatttcactatcaccgctattaggtccctctggcatctgaatccttttccctcctctcacttatcatgcggagacccccttcattctccccaaaagcagctgctccaaggctcctcctttctagtcaacatagctatttcctcagctaaccccatctctaaaactaacgccggagccgttccctcaaccgataggggatcctctcaagtcaccccctcaggatcccgtttcttccatccagcctgaagggcttctctgatgtcccctccagacatcccaaggcccctctcagccgcacccctggcacccagtatgggacttccatccgctgtggggcgcctcctctaggggacctctagatcgccccttaagagtcgccagccccggtatcctcaggagtgcctcggagctcgctcctcgcccactccggctcccccagacagcacagagggccctcacgcctcccgggggagcctcagggcctcgccgcgccgcccacaggcccctcagccccccgcccgtgcttccggccaccgcctgctcctcctcccccggtcaggccgcgccggtggctgccgcggagcccagcagacagaggcggcgcggggaccctggctccgctgcaggaggctttgagggtccccggcccccggcccaagcccatgccccctcggccggccgggcccggcgcccccgctcacccgagcccgtggtggctgccatcttgcgtcgctcttgcttgaaggccggccccttcttcaccccccccttacccgtcccccggccctgatgcgcaggcgcgcgcgcacgcacatacgccgccgctgacgcccgccccggagacctgcacgacccgtggcctggaaggctcttttccttcccttttagagaaaggaaatatctgcgtgctcgagggcccagcaacctgcaagtccccacacatcgggtgcgagggaggttgtgatgtgcttagtgagaagggcaggggtgactaggcttgggaaggcgcgattgtgaaagaaaaagaaaatatagcttcaaacaaaagcgccgaattcgcttggggctttttcctgtctagttcctatctagatcctcaccacatctccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcaaccaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaatatttttgcaaataaataaacccaagaaggtactcctcctttattataaattgtctgagaagcccttatatggatgtagacactgaggctgagagaggtgaagggactggcttaaggtcacagagcaaaatactggcagaaggaccaggactctaaacatagagggacaaggaagctggaagccctcacccagcacatccaattcatcacctttgtctgatagcagtgcctactctgcatctctccactccgttcacttctccactcagggcaagctgcctttatctcccacttggaagaccccagcagcttccattctctcccctatggcccattctccatatagaccaacatctgctcaaaacaccctccagctaaagccttcagtggctccccattccctctggataaaatacaaactttacaagttgagcgaccatagaattatcacctaatgaggacacacatcagattaaaaggggacttattataatctcaccaggacaagtggaaaccagggctctccagggcaaagcaggatgcctggacaccctgtgcaccaggctctgcacccagggcagggacgaggatggggtggtcagatttaacggggctttcactcaggtcctgactccgcacttgcacagcgctgcaggtgagtgactccttaaaatctgcaccctagggcagggcatggtggctcacacctgtaatcccagcactttgggaggccgaggtgggcagatcacctgaggtcaggagttccagaccagcctggtcaacatggtgaaacctcgtctctactaaaaatacaaaaattagcggggcgtggtagcacacacctgtaatcccagctactcgggaggctgaggcaggaaaatcgagcgaacccgggaggcagaggttgcagtgagctgagattgcaccattgcattccagcctgggcaacagagagagattcagtctcaaaaaaaaaaaaaaaatctgcaccctaggtaccccacttgcctcaccatagccttggcacagcctgcgcctctgagactttctgtacctctgcggcgacactggccctttgcaagccccctggaacacatgccctctcccacttcaggggctttgcctgtgctgttcccactcttcagttctcagatccagcaccatcccctcagggaagccttcctcgattcctccaaccacatcaaattcagctataattagctctcaaagtgccagcactggctacaggtgaagcaacttgacttttcgtgtatcacgtgatacaagtttgctttggggagcacagaaaatacttgccctggacttggggtcactgtaaagcatcagtagcaagtggaagcatttgggttcctaaggtggactcacctttgcagtgaaattttctaggttcaagtcttccttcatcactcagtttgctttgtgacttcaggtaagacgcttgaacctctcctggcatcagtttccccttctatgaggatagtagtatcaacctcataggattgctgtggagataaaatgctttcctaaaaccccttgggcacagggaagaggaagggacactagaagagctcataattaccaagccgttacatccaacttttaatcctcacaactcgatgcagcaactcctgtgaatatccccatttttagagatgagaaaactgagactcagagctaacaggtggagaggatgaggattaaaacacaagccttttatctatggtgcccgtaaatgtttactcgcatggattccttggctcttgtaggaaacttcttgcaagtaaaattgacaataataattcccgtgccgagctcatcgcaggaagaggttaggcgggacagcccgaggcatgctggttgttgtagtctagcgttggcgcagtgcctgatgggagttgtagtacgtcccgcgcacacgctccctcgaagagtttctgccccattcctggacgtcacagccggtccccagagcaggattccttccggcgcctgcgcctgatcaccgctctgcgcttgagctgataaactcagctgatgggataagagtcttgttttatcggattttggggaagattaaaatggttaatagaactagagaatttagaagagggcttggcactaagtgcaatataagtattagctgctattattacctaatcctcaatgaaccttgcaaagtagctgttaccatttccatttgtgagatgagaaaactgagacttagaggagttagatggcttttccaaggtcacacaacaaggaaggagtaaaatcagttttggaatccagttctctttaccctgtgtcacccgctggctctcccgtgatgagggaggtggagcctgggaggttttgagctaaatgtgggcaggtttgcctttttacaaagtgcatcgtgctgccatgaggagacagggcgaggacacccaattgggcagcagcaatattggtagcagggaacccagagagaaggtgtattgggcatgtttaccgccattccagtcgccatggccccacatggcaaggtgggtgtttggaaactttccctcccctcataaaagctgaagagaaggttgggcgccctggttcacacctgtaatcccaacactttgggaggccgaggcgggcggatcacctgaggtcaagatttcgagaccaccctggccacaatggcaaaaccccgtctctactgaaaatacaaaaattagccgagcttggtggctcaggcctgtaataccagctacccgggaggctgaggcacgagaatcgcttgaacctgggaggcagaggttgcagtgagccaagatcgtgccattgcactccagtctgagcgacagagcgagactgtctcaaacaaaaaagctgaagaaaaagcctatttttgtcccctttcctccttcctacaatatgaggttgtaatggttagaattagaatcctgggtgatgtggctgagctgctgaaggaattgcagggctgcccaactgcagacatctgaagacatgagataatgtgcctgttgcttaagttgttcttaaaggtaggtttttgttacctaccaccaaaaagcatacctaatagatacaggaagctgacgcagtggttcggttgagaggcatgtagacctgacagatccacaatgtccattcgtgaactctcttttcaagtgggaaaacactagggctggtttggaatctctgggatgtaaaaggcatgagtagtttgaaaaagtatattcaaaaggtgaaaaaacaaaaattatataatgttatccacaaccttcaatttcctatttatagttaaggaacccccccaacctcgtgctacagtttttgtagcataagctgcagaaagtaaagctgacaaactgtcgacaggaaggactgtggacttgcagaagacagagaggagaagggatgtgtggttaacagagtgtgtgatgaggccgggcatggtggctcacacctgtaatcccagcacttagggaggccaaggccggtggatcacctgaggtcaggaattcgagaccagcctggccaacatggtgaaaccccatctctactgaaaatagaaaaattagccgagcatggtggctcatgcctgtaatcccagctacccgggaggctgaggcaggagaatcacttgaacctgggaggcagaggttgctgcagcattgcactccaggttgggcaacaaagcgaaactccatctaaaaacaaacaaacaaacaaacaaacaaacaaacaggatgtgtgatgcatttgctagtgaaattctatggcatttatgtggagtcatggctccctgaggtgtgtctagccatggcgctgagacatcttatttaatgtctgatgtagtttccgaaatatacagtcaaaaagcggtggggatgggtgggcagggggtcttggtgtacttcattaactcactctatcaatggacatctaagttgtttccattggcttcttctgatacaatttttgtaatgtcttaattttgtattatatgttacttctgtggtcaaggaaaaaggaatgaaaactggggtttggggcagggaggtggggggacaaaaaggatgtttccttaacgtataaagagcccttgaaactcattaagaaaaaataactcaaagatgacagttacagcaaatatttattgagcatttgccatattccaggaacatggtattttgcatataataatgtatttaatcttcacacctatcctatgaggtaggtaccattattattcccattttgcaggtgaggaaactgagacacagaacggttaagtaacttgcccaaagtcacaagcttgtaagtggcagaactgggatttgaaccctacactcttaaccaatgctaccctcccttccaagaaaaataggaaaaggacatgaacagatgaggaaatgcaaatgcattttaaactcacagtaagatacccaatctcacaaaacatattgtatttcagtgatttgaagctatacgtttttactttttttttgttttttttttgagacagagtctcgctgtgtcgcccaggctggagttcagtggcgcgatctcagttcactgcaacctccgcctcctgggttcaagcaattctcctgcctcagcctcccaagtagctgggattacaggcacccgccaccacacccagctaattatttcttttgtatttttggtagagacggggtttcactatgttggccaggctggtcttgaattcctgacctcgtgatccgcccaaagtgctgggattacaggcgtgagctaccacacccagccacatttttacatgtgaacttctgaaatcaggatgcatcttagaatcagtgacatcttagaatcaatgaaatacagtaagaggaatgcaaattaaaaccacctatcagattggcaaagaacaaaacatttgataacacgctgtgttggcaagggtgtgaggaaacagggactctgaaaacttgtgaacttaaaccggcatggcctctggaagacaatttggtatgcactatcaaaatttaaaacacactcgtggttcaagcctgtaatcccagcagtttgggagtctgaggcaggaggattgcttgagcacaggagtttgagacgagtctgggcaacaaagcaagacccccgtctctaaaaataataaaaaaaaattagctcagcatggtggcatgcacctgtagtcccaactacttgggatgggaggctgagagaggatagcttgagcccaggaggcagaggctgtagtgagctgggattgcaccactgcactctagcccaggtaatagagcaagactttgtctcaaaaaaaaaaaaaaaaaaaagtcaagtccattccatcctgaaggtggaacactatgcagctgtaaaaaataataatggtttgtgaacattaatgataacactatctccaaaatatattaagtgaaaaaaggcaaggtgcagaactgtgtgcataatatcctacatattgtgtgaaaaggagtggggcagacatacccctctgcctacataaggcattgcaagtgtcttgtcaaaatgatggcctctaaggaggggaactgagtacctgagggaacatgaatggggagcaatttacccttcattctagactagggagaggttggtaacttttctctgtaaagggccagatcgtaaatattttaggctgtgtggaccacgtggtctccgatgcaacgactcaattctgccactgcagtgcaaaagcagcctcggacaatatgtaaatgaggggcatggctgtgtgccaattcagctttacaaactggaatttgaattttctgtgttaggaaatattgttccccctcccccagccatttaaaaaatgctcgtggctgacatggtggctcacacctgtaatcccagtgcttcaggaggttgaggtgggaggatcacttgaggccaggagtttgagactaccctgggcaacatagcgagaccccatctctaaaaaaaaaaaaaaattagctggatgtggtggtgtccatctgtagtcctagctactcaggaggctgaggtgggaggatcacttgagcccaggagtctgaggttacagtgagctgtgattgtgccactgcactccagcctggacaacagagcaagaccctgtctctaaaaaacaaacaaacaaacaaacaaacaaacaacccacaaaagcttctgagctatagaaaagcaagtggctggatttggcccactgtccagggtcagcttatccatactctagccctgtttatattatttgatatgagccactgtacccggcgtgattcttattctttacctatgcaagcattacctattgcttatatagcaatatatatattgctatatatatatatatacccatatatatatgtgggtagcttgaaaaatatttttggtttatcaaaggagggttggctgggcgcggtggttcatgcctgtaatcccaacacttaggaaggctgaggtgggccgatcgcttgagctcaggcgttcgagaccagcctgggcaacatggtgaaaccccatctctacaaaaaatacaaaaagaaactagctgggggtggtggcacatgtctgtcgttcccgctattcaagaggctgaaatgggaggattgcttgagcctgggaggttgagtctgcagtgagcgcagatcatgccactgtgttccagcctgggtgacagagcaagaccccgtctccaggaaaaaaaaaaggcggggtgatggagtttcagttgggggcaggcgcccaaaggtatgtgcccaggccccttctaaagaacagtgagcacacaggggtatgcaagttcactacagctcccccggttgagctggaaatccatgtttgccctgcatgccactaccctgtgccaccaccagacagcagcacatgcctacctgaaaccaagccatcccacagcagctgggagggaggctgcaggcagttggcctatgcactcattttgttttgcccacagtacgttttaaacacggagccagcatttttaaagtttagatttctggctcctgtttaaccagctgctgtgagtagcagctgccctttaggcctgatgtctccaggtcatcccagtccccagcgtcagcggccctttctcaggcatgctgcagttgcctcatagtggacacatttctcacgtgccacctgtctcacctccctctccacaatgggagcgttaaagcacaggggctttgggtcagacgctggctcaaatcctgattctgccacctaccagctgtgtgaccttgggcatattacatgacctctgtgcctcagtttccccatctgcaaatggtgcaaagagtactcacttctcagagctgcagggactgcttgacaggacccatgccagagctctctgcacagtctggtgcaaagttaagtgctcagtaatattaagtagcattttcccctgtctggccctcataggcacttgtttgcaagtccctgatctcacaagtggccccaacactctcagacccaatgcagcgcaccttctggttttgagaaggatttttttccagcccccagaattcagaagtgaaatggtctgagtctgagggctgctctacccttactacctgtgggaccttgggggagtcactttacctctctggactcaggctgagggttttttttctgtcggctccaggggaactgacacagattggtggggcctggaaaccaacaccacagtggtgaggctactcctatggcctctaaagaatttagctgcctgtcccatccaccattgacttctttttgtagtaatgccttaggaagaggtgatcacaaccctgcaaatccagatggacatttttcagccctgggcaaccagagcatttcaccccactggccaatgtgattggttcagggatgggcacgtgacccagtccagaccaatgagagcctgccctgggacttccactgcaactactgggaatgcactttccactgagattgctgagctggtctagtaagtctcaactcaaagagaaaaacagagcttagagagaccacgttttgatgaatcatgtgagcccctgggtcctgccaaaccttaattcagaacacctgtagacttttccgttttatgagctaatacgattattttagctgtttactttaaatttctgtcatttatgagttgtcgaattctaacacccttccttgtgtggtcccctcaggcatagtcacaaatcaaaagtctagttggcaaaggaaaatggcattatgggtcacgttttaaaaaataaatgtcatggctggacgcagtggctcatgcctgtaatcccaacactttgggaggccaaggtgggtggatcacctgaagtcaagagttggagaccagcctggccaacatgctgaaaccccatctctactaaaaatacgaaaattagccgggcatggtggtgggcgcctgtaatcccagctactcagaaatgtcattatctgtgactgctctggagtcctttaggcatttccctgtccccaacaggctttcttttttctggctaatattgcagaaactatctagcctagactagctattgactatgtctgtagcgttcactacagaatcgcagtacctagttcataggagatgccttataattacttattcaacaaataaacaagttactaattggtctataatgtcctgacccggtgcagtggctcatacctaaaattccagcactttggaaggccaaggcggatcacttgaggccaggagttcaagaccaacctggacaacatagtgagaccccatttctttaaaaaaaaaaaaaaatagccaagccaggtgtggcggcatgtgctagtcccagccactcatgaggatcgtttgtgtccaggagttcaaggttgctgtgagctattacacctcacctctgcactttagcctgggtgacagagcatgaccctgtctctaaaaacatagtaataaatacaaataaataaaatgaccagcaggtccccactcacctcagcctatgagtctctgtataccaaatccatgttttcccaaccttgtcttccatttttccttagctcactctagtccagccacagtggctgcctcaccatctcttaaaatcccaagcttgttctttttttttttttctaagcgaagtctcgctcttatcccccaggtttgagtgcaatggctcgatctcggctcactgcaaccttcacctcccgggttcaaatgattctcctgcctctgcctcccaagtagctgggataaagtcgtctgccaccacgcctggctaatttttgtaaattttagtagagacagggtttcaccatgttggccaggctggtctagaactcctgacctcaggtgatctgtccgcctcagcctcccaaagtgctgggattactggcgtgagccactgtgcgtggccccaagcttgttcttgcctcagggcctgtgtacttgctgtcccatcaagaggcctcttccctcacttctttcgtgtctgacctcctctcctcccccaggtctcagctcagaggcccttcatgaccaccctgccaaagcagcaccgaccctgcttttccgctgtggttctgtcctgtttgattttcttcacaaatcaccacctgaatttccatgtgcatttatttgtttattgactcttttcccaggaggtcagctccaccaggataggtctttgttggttctttcaccgctgtacctgtgtacaggacagagcctggcacacaccaggtgccagtgaatatttgctgaaggaagtcacaaatagggatcagccatcattactttatcatcatgatcaacaggaaagaccactgtcctcacccaatcccctccaaaaggctttggagcagatgtcaacattaattcactgtctcaggtgacagctctcatcctgaggccagggttggggggagctgggaatggggcgagagtggggcctcacgtcccaggctccttgataccccccaccccacccagccaggaaacaccacgaggcagccaaggttaagtagactcttgctgctttgttataaatatattatgtacatccaaaacatgacattaaaatattactccgtgttacagaaaagatattaaggctttctattatttacattaaacaagcaagcacctttaaaaaaaaacaaaacaaaaaagccctactcttccttctctgacatactctggccagaggggataccgtgtcctcttccaaatgaccaagatgctctgcaggggctgtgccctgtgaagacatcttggtattggaaacatcagctctggcagggtgggggcagcagagaagtaggggtctagacttgagcaggaggttccagcctcttctggccggctaccctcagacccctgctgagcttcaccatccttgggggacaggctaggctgaaggtggtggctggggctgtccacctgcccagcctcccggggtcagtatgcagggctgtggcagaacaatgctccacgacgcttaggtgtgcctgggggctccccagaccactggggccagacaaggagggaaagaggcaactcactggccccaacgccagccacactgaagggctgcccagcggggcagggacggcaggcgtgcagggagtgggtaaacctcctctctaccaggggaggctggcagagtcaggcttgcagatagagcaactcaggtggctgaggaggggccgaggaaaaaaaaaaaaaagaaatgaaaaatcagtggctcaagtattctgtgtcatgaggggtgggctggggtacctgggcccagcccaggagatgtcctctccatctggaggggccagctcaaagaggctggaatttggcagatggcttcggtttgggggctagggaaggttggcaaccaggtagcaggctcggagaagttatttgatcttctgggcccatttcatgtcatctgcccgaggcttctcgcccgtcaggccctggatgaggtcctccaggcgtcgccagaagcctatcttctccagagggtagttgagccagcctgcagtagaaatggcagcgggagtttgaatgggagagagtagtcaaggggacattggaagagagctgaccttcactgggctggaggggcccaatgaggagtgagtcagtacaggataggacacagggaccggccaaggaactggaagtgggggcctcccaccaatgggcctggggccactcaggcctccaacccccatattcctctactttcttactatataccaggcacttacttatatttgagcacttactatataccaggcactgtggtggccttatcactcagctcaaatgctacctctgccaggaagccttccctgatcatccacttaagcagcaccccaggtttctcacattaccctttatctatctatctatctatctatctatctatctatctatctatctatcatttatctatctatttatttgagacagagtctcactctgtggccaggctggagtgcagtggggcgatctcggctcactgcaacctccacctcccgggttcaagtgactctcctgcctcagcctccgagtagctgagactacaggtgcacaccaccatgcccagctaagttttgtatttttagtagagactaggtttcaccatgttggccaggatggtctcgatctcttgacctcgtgatccacccgcctcggcctcccaaactgctgggattacaggcatgaaccactgagcctggctctatttacaatttttttaatgcagatggggtcttgtcttatataggctggtcttgaactcctgggctcaagcaatcctctcgccttggcttcctaaagtgctgggattacacgcgtgaaccaccatgacaggccaccctctttcatttctttatagcctttatgataacctgtaaccatcttcgttaattctctattttcctgttctgtgtttgttcaccccccaatccccaactggaacgttatccccaaaatgcaaaacaccatgttctttcactgctgatcctcagtgcttagaatacagccaggcgcagagtaggtgctgaataaatattgctcacaatcttacagccttccagctcaccatgaggtagatactaatatcagtcccattttccacatgagcacactgaggcttagagaagagtttcccaattagcaggtggccaaaccaggattggaactcagccctgcctaagtagttaacccatctcctaaatagcctgaattctaatccctccacctgccttccaaggagcacaaattgaggacatgaaaaagaatgtttttttgtggttctcagttctgtttccagaaagacctaaaaaaaaatagtagctgtaatttatcaagtacctactatatgccaaacaccgcatttgccattcccactatggccctaagaaggtgatatatgaaggaggcggctgcagccctattttgtaaggagaaaagcggtccccagggaggtttgtgagttgcctaaaggcacatgtggagaagctgagagttaggcctgagttagacttgacagcacctgatacacttaaccttgaaagcagcccagctggctccagagaaactcccagttcacctcacctctttcgcactggctgctaactgagcatggcacgtgggcctcctttcccttcctccactgcactgggcatgttcctgcctctggcctgctgcttcctgttacctttgctctaatctgtgctcatctatcttcagggccctcccacacttctctcctccctcttcagttgctctgcccccttctctcctccctcttccactgctctgcccgcttctccctcttccattgctctgcctcaactccagtcaggagcctctttgccattccggaaacacaccaagcaagcaaaggccagcctcagggccttcgcacctactgttcctgctgcctagagtgcctcccacagaggtctgcacggctttgtccctcagctcctcggggtctttgttcaagtgtcaccttccctgaccacccgatttaagaggcaaagcccccacttccttctcccacccctgctttattttcctccatagcagttagcaccattagccacgctacacattttattcattcgttccagctccctcactagatggtgagtgccacaagggcaaggatccgtgttttctggtttttttttttttttttttttttttgagacagtctctgtcacctaggctggagtgcagtggtgcgatttcagcttactgcaacctccacctcccaggttcaagcaattctcttgcctcagcctcccgagtagctgggattacaggtgcctgccaccaagcccaattaattttttttcgtatttttagtagagatggggtttcaccatgttggccaggctggtctccaactcctgacctcaagtgatccacccgccttggcctcccaaagtgctgggattccaggcatgagccactgcgcccagctgattcatgctattttgtttgctgcaggagcctacgcccaaagcaccatggcatgtggtaggtgctcaataaatacgggatgatgggtggctggaatcacaacgccatgaagtcgagggagagggctttgtcagtctcatttactgtgtcctcagcacctagaatagtgcctggcacacagtaggtgctcaataaatgcatgacctgagagactgttcccagagggcaaggactgtgtgacctcctgctgtgatctctgccctcctgacctcgaagatggtgcagtggctggggtggggaaagcccattccacgccactggtggccgcacctgtggtgatgcagaagtaggtctcgtggggtgagacgtggtggatgcgatggtgtttacgtggcaggatgacatgccagtcctgcaggagggtgacccagcgtggcagcccaaagtacgtgtgcgaccacttgtggatctggttggtgaaggtgccgaagatgatcaggcagaagacgaagcactcccaggggtatagctgctccagggcttctgcaggttggggagagggggggccggcacagctgtcactcgggacggggaacccaccccaaatggccctcaccacctgctcctgggcggctcctgagctgggcaagcacccaggattctcttccaccccctgcagggccgcaggcaagctcaggtgctgccctgggcttcaggctttcctcctgctcaggaagcaggcgtaatggtgtaataggataatggcataagcatggcaatggctgggaatgtagaccggagtcagctggagctgggttccgatctctgccgacatttcttggcagtatgggctggatcggtgactctgcctctaagaagcttaatttccccatcaggaaaatgggaatgatgccttcacccaggttccctagaagcggagcctgaaacaggttcttgtgcatgtgatttatcaagggagcctcttcaggaaaaaacctcgaagggagggagggaagcaagacacggcaggggaagagcagagcaaagatggggtgggtggcgtcctgtctcagtctgttcctgcaaggagctctgaggtgttaacggctctttagaattagacccactcagaggcaaagggactagcgtcggaggcgtttcagtcactggctccagccttatcccaaggagacaggtgggacctcccctccatccctggagaagctgggagctgtcagcagccaccactcacagaagcaggggctgggtgcacccccagggaaggggatgggcagggtgccatagcacccactacactacacgtcctcaccacctctacccaccggaggctgcctgaagaacaaatgggtgttaaggtgctggaacaggaccgggccccaacctacctccacctgacagataaggcaactgaggctcagagtggtgaaatcacttactttgggaccagtccctctaaaaataggcaggccctgttttcacagcctagacattttccactaggccacggtagcaaaaccccagaagccctgccaggcaggtaacacaaatgaacaaggtgggttgggtgcagggaagcaaggaatagtggggacggtggtaaactggaaagacgcgtcctgtcaaaggcagtggctgcagctcagctcccacccagtgaggccaggtgggaacatggacccaggggggccagagcagattgtgcaagagaagctggaaacctccatcttcatgtcaggtttcctgattttacatgaagacaatgaatgaaaactcttttaaaataccataaggagccaaacacataagccccagaaggctcctgggggtcggcctctgcccccaaggccccctcccagcccaccactagctgggtgtctcaccagggctgtgggtgcggaacttgtaggccatgtttagcagcggcagcagtgtcaccaggcagttgtccccgttggtctcgatgaagtcgtgccgtgtgatagctgtcgggtcaatgtggtgctcccggaagggtcggatgaaagcctggagttgagggggacacagccccagcagtcagcctaaggtggtcagctgctctccacagccccctaaacacattcaccctgggctcacctcccgcctttgatcctaagtttcctccacccgggatgcttgaacattcccacctggcccactgccagacacagaccccatccagcctttggggagatgagccgaaatgaccctggaagggctttgggttggcactgtctgcctctgggcctcagtctccctacctgtgctgtaagggggcttggagacaacctccgcccttcctccccaccccaaggcagttgaggaggtccctctaagtaaaaggtgggaccctctggaccccctgcacctgctggggtaacagcctcccctccttagtccaggctcttctgacaaggctgacctcgccccgggctgagaaagaacacgtgaccaggcctggccaatcatagcatctcctccctctagccagtgactgcctgagggcccagcacgtgacccaatctgggccaatgggagtgagccgtgggacttcagttggcggaaactacagggaaggagaaatgctgttctcctggaaggagaaggacagttctcttttcttgggagctggaaggatggatctctgggcggtgagaaagcacactggccaccttatgaggggaaagtagagatagagatggaagaagactgggcctgaagaatgtggtctgtcggtcctactggatgcagccattccttaatttggctctaaccctgaaatcttcagttacatgaatcagtacccttgtttgcctaagccagtttagattttctgtcaaaaccaaaaaagtgactaatacaggataaaatgcagttaaaacagcaagaagcagcaggggagacaatggaaaagcaagacacccccaaattcaggggttctgatgaggcaggcacatatctaaactcttggaccatcccaagcctgatgcttttgcttccaaaatcccaagggactcctgttctagtcttgcagcacaggggtgagggacaggctgcaatgatggttcccatctttcagatagggaaacagtcttagagaagaaaggggactcactcaaggccatacagcccaacctccttcttgaggacatggttaggtcaacatactcaccttccccacaatgggcagctccacagagccccatgtgtcagcaccccagtgtaccaggccagacaagaagtcagcaatgagagcccctgcaactgtggacaagagggtgagtgaagggacatccctgcacccccccaatcagaatcactcattcatttactcacttgcccgctcattcatttgttaggaggggaaggtgtcccttcttctctagttgggatgttttcttccctgaagatggagcctcaggcttaacactcctcctgcctgttacttgctgtgctcggggagatgccaagactcatgtgcttggagagtctggagagcataaactgggcatgctcagatcagctcaacctttccctattaggagcaggctgtgcccttctctctgccccatataaggaaagcctgctctgcaccagtgctgcctggaactgcagcaatgtccttctgggtttggtgttagaaagaaagtacctcggccaggtgcggtggctcatgctttgtaatcccagcactttgggaggctgaggcaggcggatcacttgaggtcaggagttcgagaatagcctgaccaatatggtgaaaccccgtctctactaaaatcacaaaaattagccaggtgtggtggcatgcgcctgtagtctcaactactcgggaagctgaggcaggagaatcacttgaactcgggaggcggaggttgcagtgagctgagatcacaccactgcactccagcgtgggtgacagagtgagactccgtctcaaaaaaaaaaaaagaaagtaccttacctgcagatagaagcctcgctgctccacccccacccctccagcttttatcagcaataaacatgatcatttggtctccagcagccttttccttgtttctgttctcaatctgttcggaacttgagcagggttccctcagactccaacaccattcactcacttgagggttcagtagatttggactcaaattccagtgctggcactcactagctgtgacgctgcacatgttatttagcctctctgtgcccagtttcctcttgtaaaatgggaatgatgcgactgggcgccgtggctcacacctgtaatcccagcactttgggaggccgaggtgggcggatcacctgaggtcaggagttcgagactagcctggccaacatggtgaaaccccatctgtactaaaaatacaaaaattagccgggtgtggtggcacacacctataatcccagctactcaggaggctgaagcaggagaatggcttgagcccgggagatggtggttgcagtgagtcgagatcatgcactgcactcctgcctggccaacagagtgagactctgtcttgaaaaaataaataaataaaagggaatgatgctaacatttacgagcactttctcaatgccaagcacaaatgctttacaggctagatcttgatgaattctcaccatttgttttaagttggtagcttttttattcccactttatagaggtggaaactgaggcttccacccctgctgcctcccatcactctcctctttcgctgcagcccaggcctactttatctcctttcccttgcatgcctctgggtctttgcatttgctgttccctctgcctggaacattctttcctaagatgcaacacagctcactccctcacctcttcagatgtttactcaaatgtcctccctggacacctgatggaaaattgcaaccacctcatcttccagcatttccgatctcctatgtatattgttctccaagcactcggcacctctgactgctcttgtgctggtttattttctcccccaacaaggaggttggctccaccatggccagggctttagtctggcttgtggctgcatcccagctcttggcacctattcagaactcagtagagcactactaagtgcagtgtttggcacatagtaagccctcaggccatattactgttgctgtcattgagtcaatcaactaagccacactccacaaaggcctcctgtgtgataagctctagggacagaaacatgtcagacactgaacacatgtctatggggaaacgctgtaaagtccagcagaggacaaaggcagctgtgagtgatgacacgtgtggccccctggctcatggggcttcagacaaaccccttcccagactcggtttgtctgtgtcaactggttgtccaagattctgagttctgctggtgccctcaaccccttggtgacaggggaccagggtcttgggggtactgtggagactgcagaaaagcccctggatgcctcctgggtgagtgagacttgtggttgaagggacaaaagtaagcacgcaagtcactgtgaatgtgcaatcctgacgtccaggcctggggtgaggggcagccactggatgccgactttccagaggccctgtggtatccatcacaggtgccaagcacgggaggggtggtgggggtgggggcagcacagcttcatgcaggcacctgcaagttcctggggataagggcggaagggcaggtggggacaggtggcagctacacctcctggcacacagacgcctaaggacaggctgaagggtgtcactgcacagtggctgggctgaggtaaaggggttgggactcagcaaggccccagagcctgtgcacccagtggccctgctctggtctgggcagtcttgcccatttgtgatggggagggtggacccaggccaggggcaggggcggggatgtagaaggcgagggaggtggaagccccagaagggcttctggattttctgttcctctacacagcaccccacccccactccagatcccctgtgctggctcctcctcggccttcttgctcagagcgaaggtcagccaacccttctggctaaagccatccttccgggcagttgctctcgctcacatctccctgcttcatttctttcatggcacttgtcatcccctgagatggcctcatttgtcatcccttcttggatgaagaaagaggcctggagaagttgaaccactgcctcccagtcaagtggcctggaaatggcagctgtgggatgggaagaggcctgtcgacctgcctccaaaaccagcacccttttgtgtccttaaactgcactgcagcaggtccatggcattattagagctcctactgcatactttgggatgctgtgtatgcactgcctctgtctaccagcagggacaaaaggccatgtggccaagagctatgacagaactagatcaagtgttgggggcctcagctcttgctaccatattgctgtgtgacactgtgcctactctaggcctcagcatctttacttgcttaatgaggtcaactgaggtatctcgaggtcctgtccccatagctcggactaatgacatctctaaatgctgccttcaggctgggctggagcacagtgcagagctgcagagctggcaccattgcactcctcccagcactttgggatgccaaggtgggcagatcacctgaggtcaggagtttaagactagcctggccaacatggtgaaaccttgtctctacaaaaaacacaaaaaattagccagggatggtggtgggcacctgtaatcccagctactcaggaggctgaggcaggagaatggcttgaacctgggaggcggaggttgcggtgagccgagatttcgccattgcactccaggctaggcaacaagagcaaaactctgtctcaaaaataaatgaatgaatgaatgctgccttcatgaaagaaatagctacagaggagaagtggctggatgtcataagggtggggcctcgcaagggattcagagtccaggttccttgttccccgagttctgggctcctgatgagatggggacaagccccttcccctctctaaaccttggctcattttatgttataattgaatataacctacaaacagtaaaggccataggccttacacagctcacagcctttttatgcgtagacacacctgtctgaccaacccccaggttaagatagagattctatacctacacagaatataagaggttggcaaactttctttaaagggtcaggcaggccgggcacggtggctcacacctgtaatcccagcactttgggaggctgaggcaggcggaccactggaggtcaggagtttgataccagtctggccaacatggtgaaaccccgtctttactaaaaacacaaaaaaatcagctgggtgtggtggtgcggacctgtagtcccagctactcaggaggctgaggcaggagaatcgcttgaacctgggaggcagaggctacagtgagcagagctcgtgccactgcactccagcctgggcaacagatggagactccatctcagaaataaataaatacataaatggacagtaaatattttgggctttgcaggccaaggcagtctccactgcagctcctcaactctgcagctgtagtgtgaaggcagacatcaacagcattcccagaatacctgtttacaagtgtttttggtcctcaggccatagtgtgctgacccctgatagaaagcatttccaggccgggcacggtggctcacatctgtaattctagcactctgggaggccgaggcaagcggatcgcctgaggtcaggagtttgagaccagcctgaccaacatggagaaaccctgtctctactaaaaatacaaaattagccaggtgtggtggcgcatgcctgtaatcccagttactcgggaggctgaggcaggagaatcacttgaacccagaaggtagaggttgcggtgagctgagatcacgccattgcactccagcctgggcaacaagagcaaaactccatctcaaaaaaaaaaaaaaaaaaaaaaaagcatttccagccccacagctggctcccctgtcccactaagctcccttctgaccctgttccatgcaaccatagagctgcctcctatcagcagagactgattttgcctattctagaactttatttaaacggattcagatggtaggtgctctttggagcctggcttcttttactagtgtaatgtttctagcgtgggccatgcagtcgtgcggatcagcagtggttcaccatttttagggctgagtatcccaccatctggatgtacaatgatgcatttatccacctggccatggttggccatttgggctgtttccagtctggggctgttttgaatctgctgcagtgaatattggtgtacaagtctatgtgtagacatccaccctcatttactttgggttaagatgtcaactactttttttaaaaaaaaaaacctgatatttattgagcacttataactaccaggccccgtgccaacgccttaaatgttttatctcctttaatccctgaatggcatcaaggcctcgcttaggccgaatcttatctccttaatcattctaaacacttaatcctcacagataatgagaaagatgagcataataaaaattatacagatgagaaaacagtagttgggttaacactgtgtactggggctttgtgaagtgttaagaagtgcatcactgggagcataacttcccattccttaagtgtgggctgtgtacagagacctccttccaaaaagagcacagtatgaatgaggacggaggctgggcgcagggctcacacctggaatcccagcactttgagaggccaaggcagatggatcacttgagttcaggagttcgagaccagcatggccaacatggtgaaaccccatctctactaaaaattcaaaaattagccgaccatggtggtgtaggcctgtaatctcaactacttgggaggctgaggcaggagaatcacttgaacctgggaggaagaggtagcagtgagccaagatcgtgccactacactccagcctgggtgacagagtgagactctgcctcaaaaaaaaaaaaaaaaaaaaagaggggaggaaggctgggcgcattggctcacgcctataatcccagcactttgggaggccacggtgggaggattgcttgagtcctggagttcagtaccagcctgggcaacacagcgaaaccctgtctgtatataaaataacaaaattcgccaggtgtggtggcatgtgcctgtggtcctactggaggctgaagtgggaggactgcttgagcctgggaggttgaggctccagtgagtcgtgatcgagtcactgcactccagcctgggtgacagaggaagacttcatctcaaaaaaaaaggcggggtggggggagcagagtaacttttgtttgttgtttttttgagacagactctcccactgtggcccagactggagtgtggcggtgccattcacagctcactacagccttgagctcccatgctcaagcgaccctcccacctcagactcgtgaggagctgggactacagctgtagagacaagggtctcaccatgttgtccaggctgaccagtgaactcctgagctcaagcgacccactcacaaatcctaaagtgcctcccaaagtgctgggatgacaggcgtgagccaccgcacccagccgagggtaacttaactgtggagaactctgacatctgctaccttagtcatgggatcagagtcatcacagtgataagtcatgttgacagtctgtacttttgctatgatgtgatgaaaatggcacttcacctctgaactcttcctcctcataacccgtaaccccagtctaatcatgagaaaaacatcagatagataccaacagaggggcagcctacaacacacctgactagcactcctcaaaaccgtcaaggtcagccaggcgcggtggctcactcctataatcccagcactttagaaggccgaggagggtggatcacaaggtccggagattgagaccatcctggccaacatggtgaaattccatctctactaaaaacgcaaaaattagccgggcgtgctggcgcgcgcttgtagtcccagctactcgggaggctgaggcagaagaatcgcttgaacctgggaggcggaggttgcagtgggccgagattgcgccactgcactccagcctggcaagagtgagactccgtctcaaaaaacaaacaaacaaaaaaaactggacaagaggagcctaaagggacatgacaactaaaggccatgtgataccctggatgggatccaggaacagaagaaggacattagggaagaactaaggcaatctgaataagccatggactccagctcatgataatgtatcaacactggcacacactgtaacaaatgtgccccgctaatgtaagatttaggatgtgaataatggaggaaactgcgtgccccaggcatatggggactctctgtactatctgccccatccttctgtaagttgaaaacttgttctaaaaaataaagtctgtttttcaaaaagtggacaatctcacttcatgtccacagtaacaggccccaccccatcctgaccttccagaggagggtaagaactccccaaggtcacacggtggcaggggcaaggcagggctgctggtgagtagccagagactcgctagagtcattcaggatgatgcaaccttagggttagggttagggagacttcgcacccaggtatggagaatggggacatttacctcccttaactatgagaagttaataaaatgggctgctgggtaaagggcccggtgggtcccacgacacagcaagcatccccccaacgcagctcctgtgagctctctgctgagcctcagtcttgccatctgtccaatggtcaaggcctggcgcctgcacgctgcccagcagggagggatgtctgctttggacagaagtcaggaatcatcttaggagaccaggagccctccccctggctccgtgatcttgcggcctctgccggtggcagtgactccaggctgctgtctgaggctgctttaatgggggcaggggtggcagacaggcacacagaagcctctttgtcccagctttggggtggtggcagctggcagccggctccccctgggggcagcttcggcttggttaccacccttccccgcagaacactgggacaaggagagggatgggagacggctcaccccaggctaccctgactcacgggggaacttgaggtagtcgctgggcccgtgcgggcttccatttccccagaggtcacccagctgggacttcctcacccctccctgcccacctcaaaggcctggcgtggagatggaaggcgtggctgaggagccaagtgaatgcactgagggcaaatccatgggtttcggtcctgggtcccagtcctgtctctaccgccttccagctcagtcagatccagactccacttccagccacaggacgggccacgacccgagcctgggacttctctgacctcatccctgacctctggactcactgtgccctctgcccggaaggcttctcccaaggtccacgaaggactctgctcctttaagggccaactcacaacccaaacacttcctcccccttctccacgtggaacaaaagctcagggctcctacggccttcacttgttcacccactcactcacgacaacgatgtgcgtgtcacagtggctgatgacctccacgtggctaaatccaaaggtccctttactggccaccttgctggtccactcggtggctgttcccagtcgacccccaagactcctggaaacacattctcctcttggcccctgcaagccctccctggttctcccccgacctccctggttctccccccatctccctggcagcgccatcccagcctcccttgctggctcttcctcctccccagcctggaaacacgggagactcagcccctgggggtgctcagccagcctaggagataaggagcttcatcttgacacagatgacccccggatttctttctttttttttttttttttccagaggaagtctcactctgtcgcccaggctagagtgcaatggggcgatcttggctcactgcaacctctgcctcccgtgttcaatcaatttctcctgtctcagcctccccagtagctgggattataggcgcctaccaccatgcccagctgatttttgtatttttagtggagacagggtttcaccgtcccaaagtgctgggattacaggtgtgaaccaccatgcccggccggacccccagattgctatttccagctgcctctccctgcctccagacctagatttccagtttcctgctcaacacctctccttagctcaacagcggccatctcaagcatctccctcaggcctgctctgccgatgacctctctccatctctgtgaatgacagcttcatcccttccatctctcaagagagaaaccttggagtcaagctaattctctctcacctccacagccaacctggaagcacattctggcagctcacctttcacagctcctccagaatttgacaacgcatcaccacctccaccgctccacccaggtctgggccacccttaggtctgggctgccatcttcacgtggctggaccatggcaggcgcctcctccctggctgtccccacccccagccatcttccctgcagcatcagatgatgtcaactccctgtgggaaactcaccaatggcttctcatgaccccatatccagaccaggccctcatggccccacaacatctgcttccagtgccttgctgggctgccacaattttcctttgatcaatttcctccagccacaatggcttcgctctgttccccaaacacacgaggcacgtgccaacctcggggcctttgcatttgctcttccctgtgccttggatgcccctccccaagatctctgcacggcccctccctcacctccttcaggtctctgtgcaaacgtcatcttttcagagaggcctttcccgcctacccgcttagcttgattttgcttcccaatgctgcatcacgtgtgtctgtgtttattaactcgacatcttttcgtgcttctgccttccttgatttctgggacctgcctgggacagtggaagctctggggagataggggtagggggcaggctctgcaggctggcacagtgcccttactgcctgcatgttaacacacaaatcggggtggctatttaaatcgattagggactgtgcaaacaccattatcaggggattgtctgctctcatcagcccagagagaaatgtgtgggatggggaagctggtgctgtgcagcctcgaaagccagagatttcctgggctgtggctggaagatcagatcccaaccagggaagggagatagtgacctacctgggacatccaccctcccagcctgcacagcacacacctgggctctgatccagcccatcctttacccccgtagaggcctgaaacagcctggcctcccaatgttaactggaggctatacacgccctggtggggaagtcctcaactgagagccaggcaggtctggatttgcaatctcagactctgctgctgcctgggtgaggaccaatatgtgacttacttagcctctcagatggtgatgggaacctcctcactagggtagcacaaagagtgaaaagtgcccagcatggggcttggcacatagtaggtgctcacaaaacatccgtgattaaactgaccagcgaggctgaagtgaaagccttgatcagtggtctggcaggtgctgtcccctccccgcccctgcttagtcactggttttctcagcacttaggcacacctgcattttgccttcacaacagccctaggaggcaggtactgccagcagcctcatttacactgtggtaaatgaggctgagagatgcaatgtggcccaaggccacagagccaggaggtggtagagctgggacttaaacccaggtttgtagaggcctgctcgtaaccatccccagatgaggctgcaaagctcagactgtattcctgcccttgaatatggggcttgaggcagagaggctgggggtgcaggtctctcccatccctgggggcaggggacatgcctggctcctgcctgggcttcccagcaatggatgggttcatctctctcccctccagctggtccggcccccgtccccagcatataccaaccccaccccagacccagatggctcaattagctggcctgagcactattggcttaggtggctagaacgcttttaatgagattgtgggagttgaacccttaggaagggccaggcaggaccaagggcacagccgcccccttcagtcttggagccggggatggggaggggaagggtggtgcatggagaggaaggaaactgagtcatccagggcctgggagtggagatagtgtattaacaactatgttgtactctgccttgaagtgtgactctggactagtcccttctctgagcctcagttccctcatctggaaaatgatgacaaccttagcgtaagaagtgaccgatggaaaacaccaggaggtactaataaacaacagctctctcatttattcattcatcaattcaaaaaatactgagcaccggctgtgtgccaggcctgaggcttgagctagggacacagcagtgaatgaaacagacaaaaatctctgctctcagagagctggcatttgagttgggagagatgttgggagagatagatgataaacaaataaagacactgtggacacagtgttaacaacagaaaagggggatagtgtgtgacaggcctgctattttgagacggagtctcgctctgctgcctgggctgaagtgctgtggcgtgatcttggctcactgcaacctccgcctcctgggttcaaatgattctcctgccccagcctcccaagtagctgggacctacaggcgcctgccaccacggccggctaatttttgtatttttagtagagatggggtttcaccacgttggccaggctggtctcgaactcctgacctcaagtcatccgcccccccccccccgccccaacggcctcccacagtgctgggactacaggcatgagccaccacacctggctggggctgctatgttttgtggggcaatcacacctcctctgctgagaggaggtgacctctcagcagacacctggagtgagccatgtaggtgagagttctaggcacagagaatggcacatgcaaaagccctgaagtaggaatgtatctgagagcaggtgacagacgcacagtcagggggccagcgtggcaggtgcagggtgacctagcatgagggtggctagaggaagctggggcaggtacactgaggagccggtgttctattcagctgcagatgtatgcagatgagagtgggggagtggcatgatctgcctggggctctagcaggatccagctagccatgtggagactggacggtgcagggcaaaggtgaaggcagggagaccaggaagaaggctcctgaaacagcccaggcgggagaggatggtggctggacaagcgtggggaccatgaaggtacagagccatggctgtactcctcatgcagtttgaaagtagagttaacagcatttgctgatggtttggatgtgcaatgcaagaggaagagaggaactgaggatcatgtttaggttttgggcccaagtgacaggctgcagggaggtgctgctgactgcaatagggaggtggggtactcaaggcacatactggactcaagcacacacatccatgcatgtggacacacacacgcgccagttacccggtgggtccctggcccctagggaagttgaggcaggcagcagtgcctcgggcactcaccaacaccgagtatgacgaggggtgtgtcctcccagcgggccagcagcaggagatggaccaggttgtgggcgatgaggctgaagcacaggatcacagagcaccactcctggaggcgcttgcctgcagggagcagaggcgagaggtaaaggctggaaggtcaaggccaggcagagtgtggccccatgggaacttttcttttcttttttttttttctgagacagagtctcactctatcacccaggctggagtgcagtggtgccatctcggctcactgcaacctccacctcccaggttcaatcgattctcctgcctcagcctcccgagtagctgggattataggcacccgccaccatgcccggctaatttttatattttttagtagagatggggtttcaccatattggccaggctggtcttgaactcctgaccttgtgatccgcccaccttggcctcccaaagtgctgggattacaggtgtgagccaccgcacctggccaggagcttttcaactttgtttaatgcatctatattgccaaccacaagctgagcttacagactcccgcaaaggagtctgtacccatttcacagatgacgtcactgaggccctcaccaaggtcaaacagtcagggctggatgcattaaaccaaggatggggcccttcagagagtggcccaattctctgacagaccaattctttgacagacaggaccagaactctggtctcctgggcccctctgggctctctctggagacacctaagggaactttaatgagcttctttttctttttttaaagtagaatctttgtggcttcacttgtccccttttgcaggtaactatttggaggcagaggctacaaacaacctttaatcctggtggctcacaccctgcccagcctccctcaagcaggctccagacaatgagtcaggaattcatggacaaatagggctctggggcagtggggcttctaaaagtatggcgtgtgggccagggaggcagagcttctgattcccaagaggagccagaagtcaggctttgggtgtgcaatctgtttcagtgttgccacatagttttcacagacacacgagcccagacaagctgattcactcgctgcagctttgtttgtggtgtcaaaacttgggaaataacctaagtggccattgcctggggattggccaaatgaattcagtccacatcatctctgcagccaggaaaacacctgggcagttgtctataagtggacgtggagagatgtccaggacatctaggtaagtgcaaaaagcaaagtgccaaatagcagccatttatgttaaaaaaaaatctatatagttaagaccggcttttcccttatttccttttaaagtactagcatattacattgttttcttttaattgtaaattaaaataaaaaaataaaagggggccatgcatggtggctcacacctgtaatcccagcactttgggaggccgaggcaggaggatcatttgagactaggagttcgagaccagcctggccaacatggtgaaaccccatctctactaaaaatacaaaaattagccaggcatgtggcgggtacctgtaatcccagctattcgggaggctgaggcaagagaatcacttgaatctgggaggtggagattgcagggagctgagatggcaccactgcactccagcctgggcggcagagtgagactccatctcaaaaaataaaaactaaaataaaaataaaaataaaataaataaaaggggttaggcccagtggcttactcctgtaatccaagcaccctgggaagctgaggcgagaggattgcttgagcccaggagttcaagaccagcttgggcaacatagcaaaaccctgtctctattaataaacaaaacaaaacaaaaaattttaaacattaaaggaaataaggccgggtgcagtgtttcacacctgtaatcccagcaccttgggaggccgaggcaggcagatcacctgaggtcaggagtttgagaccagccaggccaacgtggcgaaaccccatctctactaaaaatacaaaaactagccaggtgtggtggcaggcgcctgtagtcccagctactcgggagaggcaggagaatcgcttgaacccagaaggcggaggttacagtgagctgagatcacgccattgcactccagcctgggtgacaagagtaaaactccatctcaagaaaaaaaaaaattaaaggaaataaaaacaccatgtgggtgacatagaacatgtgactagggtatgccccaggcagctgctccataaggcacagaagacctttaatgacaacaattttatcatgggtgtttaaaatatactgagcagttactacatatcaggcgcctgctgaagtgatgtccttttgcagatgagaaaactgaccatcagagtggtcaaggaagtagcccaaagccacccaactagtcagcagagaccagaattccatggccagaggtctggctcctaagatcccgctctcgccccgctctatcctgttcctgctgcccctggtccctccctctattccccatcaccctatcaccttgacgacattctgggtcaggagcccaggcccccacttaagcagcggggccaggcaggtccctgtgaaggggtcagggccagagcaggtgagaagggctcctcctgtgtccaccctctcttctttttaggactctgtgcatgctgttctcttcactccctgtgcacctgacactgttcctgcagatctcaccctggaaacctccatctccaggaagccatccatgatgcctcctctgaccccacactccccccacacgaggcccattgctcatgcctgtggccttgtctacgtttgtctttccctacctaaatgtgaagtcgggaggcccagaaccatgtctggctcactcaccagggccctgacactcagtaaatgcttgcagaatgagcaaattcccaaccacaatcctaacggacaactccatggctttgtctctgggtgccgctcaccgacataccttgggaaggaagtactgggttccccatttgtcatgatagggaaactgaggctcagggagagagaaggccttctccaggtcacacaacagcaagctgctcctgacctaccctgacccagaaccaggacagctgccctcccctgccccttgaaaagaccaaggctcagaaggggaacggaacacaccagggttacatgcccttggctccttttgtgcagaagaagaccgtgaagcccaggaaggagaaggacctcaacagaggtcacatagcagaggtcacaggggcctagatctcctggttccccaattctcaggcgagggctgtttctcttgagccacgcagcacccccactgccccagcagccgccccagcctggggatcaccatgatcaggcccagcaaggccttcccctttctgattcttgtttgtagccaaggcccagggctcagaagcagaaaaccccgagtgggtggggtgggaggacacggagaggcggtgagaaggaaagaacaagtgaaccttcccgatcgacctgcctgcctgccccacagcatgcagggacaggaagtgggcagagccaactgcaacatgatcaaataacagttaccctaacaatggctgacacacactgaagcctgtcatgcgctggggtgtggcccatatcggagaggttgcaaactgactccctctgacatgttttgccctcagttttaaaaagtgagctaaatttgaaaatcacgtaaaattcctagtttcctgcttccctcaacaacacagggctctggccaccctaggcctaaacaataagtaatagctgcccccatccaatgggatatgagctccaggttcaccctggtcctctcccttccctggggtctcacactgggtggccagatttggtggcagccctggctgggcccctgcagtcatctgagtttttgagtctgaggcacagtctctcattcaagtatcagcccgtcaaggaaggaactgagtgatctcatttcctagacaaggaaactgaggttcagagctgggtttggatcccagacacatcaatgagacatgttagcctggacgttcggggcagtcctgaaaccaaagatgatccagctctctccccacgccatggagaacgtcctccaaatctgaatatttttccatctaaactccatctctctttggcctctggaagctggatccttctgcagaccaaataccttaattctcatccataaagaatgcatacacaatggccgggtgtggtggctcatgcctgtaatcccagcattttgggaggccgaggtgggcagatcacgaggtcaagagttcgagatcagcctggctaacatgaacatggtgaaaccccgtctctaagaatacaaaaattagccaggtgtggtggtgtgcacctgtaatctcctagctactcgggagggtgcacctgtaatctcctagctactcgggaggctgaggcaggagaatcacgtgaacccaggaggcagaggttgcagtgagccgagatcgtgccactgtactccagcctgggcgacagagcaagactccgtctccagggggagaaaacatacacaacttaagtagctttcactgagcaactggaacatgccagatacagggctaagatgatctcagcacccctcaccacctcctggagctagggaccctctgtcccatccttcagagagagaagctgggcctggagaggtcaaggcacttgtccaaagtcacttgagggtcaccaaagtcacagcatggatcatcagcctggcagggcctgtggggtcaactggcctaaactgtatcacttaacagatgagcagactgaggtggggacagggagggtggctgctcaggacacaggaggcccgggctgtcttctggctgtagtgctgaggtcctgctatcagagccagcccctggcttggcagggtttgaagatctgagccaaaagcagtagccacttattggcctgaggaaggggctggcctcgtgtggtaggtatggggagctaggaagagcaggggaggcctggggtcatgcctttgtcatcctgctttccaggggacaggctgcagtcaaaggcttggtgggcccaactcttctggttccaggcagagacaagccccaaataagctggacttctgaggacccctggcctccagcagaccctcagcctcagggagatgggggacaagaggtagagagaaggtggggatgagagatggacagagggacaaataagagatgagagacaaataaggaatcagagccatgggaagatgagaaacaggctgagtgccgcggctcatgcctgtaatcccagcactttaggaggcaaaggtaggaggatcacttgaggtcaggagttggagaccagcctgggcaacataactagatcctgcctctacaaaaataaaaataaaaattagctgggcgtggtggctcacacctgcaatctcggcactttggaggctgaggcgggaggatcatttgagctcagaagttttgggttgcagtgagctgcaatcgctccatcacactccagcctaggtaacagagcaaaaccttgtctcaaaaacaaacaaacaaaaaaaccgaaagaaacaaagatgagaaacagagacaaaaggagcaaaaaacagaaagcccatctgggggactgaacccctgggttcagctttgggagtacaggccaggactctcacccagtactcctgacaccctccacctttcccttccccctgtgccaagagcctctgtaatccccagggcagggggcacccacagttggcctgggtggggtacaggtggatcaaggaccgtgaggctgcacccatgaagcctggggcacctgagaagtagcacacacatggccagatttcagctgggacctcctgggaagctggacacccgcctcaccctctggcctgccaagctggccaggcccttcacaaaccctgacatctggcatgaggtgggctgctgctgggaaactcagcccagaacaggacagaacggctcctgggtcctgcaggaccagggctcaacctctgggccagacacttggggcctgcgaaatcaggctgtggccgcctccctgctgcacctgtcaccattccctcagccccatgctgctctggtccaactactcacagctccctacacacagaggcccattctctgccacctgccctgcacacatgctgttctgatgatccggaatactcgcccccacctcccacacactcacccctggctggctgacttccatagtgaagagtaagaacacagaacctagcgcacccccacccggcccagtcccgggttccaggcctagccctactgctgcccggtgccccgccgtatgacctcaggcagcctctcccattttctaagcctcaggaaatgttccaacaaaagtggactgggtgctcatgaggggccaagcactttaatcaaaccaaataggttcagtccctgtcctgctggccttcccatcaggtgagggcagatgcgggcctaaccccgatcagggtgagctttaggaagagcatgcctggggtgggggttgggaggggttgcagcctcctcctctgtgaatgcagttaatatcaaggtacagctcacacggttgtagtggggatgcacggagagcaggtgaggaaaatgccagcacagtgaggctcaatcactcggctatgttgattgccatgattatggctgtcaactgtcacagtgccaaaccacctccagccccagtaatctcaaacattctgctcctagaacccaggaacttcttctactcttccctccagcctacatgtgtcctccatattccctaaacatgcctggcaagctcccacctcagggtctctgcatttgttgtttccctggtctggaccaacccttcttcaaatatcctcaaggctccctccctccagtccttcctcccttcaggcctcacttcgaatgtcacctgctcagggaagccttcactgccccctccctaaaatgtcattcctgtccccaacatttcagatccccctctcctgctatgtatttgctccacagcgcttgccaccactgggcacgtgagacagttatttgtcaagtttatggcccggctatttactaaaatgccagctccgtttttttctttttctttttttttgagacagagtctcgctctgtcatccaggctggaatgcagtggtgtggtattggctcactgcaacaacctccgcctcctgggttcaagagattatcctgcctcagcctcctgagtaggtgggattacaggggcctgccaccatgcccagctaatttctgtatttttagtagagtcggggtttcgccatgttggccaggctggtctcgaactcctgacctcaagtgatccacccacctcggcctcccaaagtgctaggattacgggtgtgagccaccgcgcccggccagctccatttttttctgtcttgttcaccattctgcccccagagcctagaacatggactagaacataggtgttcaatatgcactgagcctggtctctcactttttcaggcccagagaggtcaaatacttccccaagatcacacagtgagcagatagaagcagagaggccagtggaaaggaagttggagaaaccagtttggcaagtctcctcccctacctccaggtctggaggagataaagggccttgattgcagatttggggcaccaggctgtctgcagactctgattcaggcatggctgttcttcagagagtgaagggcacttggggaaaccagaaatggacaaatatgcaattgatcgtggtggagtggggaaacagcaatccctggggaggctcagaatgcctgggaatgatttgggctgtctgaaagtaggtagggttcacaggagcaggcagagctggacactaaagagggaggcccttgaatccttatccccaattcccaggtggggagtttgaggaccagagaggtgaggcggatcccccacagcaaaggtcagactactgttaacaacagggaggcgccaggcacagtggctcacgcctgtaatcccagcactgtgggaggccgaggtgggcggatcacaaggtcaagagatcgagaccaccctggctaacacagtgaaaccccatctctactgaaaatacagaaaattagccgggcatggtggcgggcgcctgtagtcccagctactcaggaggctgaggcaggagaatggcgtgaacccgggaggaggagcttgcagtgagccgagatcacgccactgcactccagcctgggcaacagagtgagactccatctcaaaacaaataaaacaaaacaaaacaaaaaacaacaaaaaaacccacacaacaacagggagtgcctactgaatgccagtggacgatctcatttccacttcctaacacgaaggggcagataaactttaacttgcaaggaaaccaaggggaaacagagacggaaagtggcttggaccaggtcatacagctgaataacagagtcaggatgttaaccctggcctacccccaggagagcaggaggttttaagtccataggctgggtgtcttgggtataggcctgaagaaaccatagcggcatggaccaggtgcccaagtcaggtgtgaaaaatcacatacagagaatggagtggtctaggacccagtgaggaaatgcaaatggtccgtggccatgccgccttttaaggaagagacggcatggaacccaggccagtgagggcagaaagctaaggtgctagtgaccccaggcccactccaggcaagggctgcatgtggtgcttggtggctgccccacagaaaaaggaaggatgtcaggatatttgacaaacaaagcttcattccatggtgacacccaggtagaggtgcctcccagtcacctgaaccaggagttctcaaaggcacttccttaactcctggggatatagggccctcctgaggccaaacagtaaaattcctagggctcacgtaggagtcacaaaagtgggtgtagggggggtgcttgctggagcatatacagtgagcaaagcaggaagaagctagggagaaaccgtggcctgagggaaagggacagagagggagaggtgaactccaacttatgatctggtctggggaatatgggggttccagtcccaagtcctaaggaaggggccaatacatggatgtgagggaggggcaagagctagagttggggcttatgtacaggggagcttacagtggggtacattcagtcccctcactgcctgggatccaggaatatggggcaaggactgatgctcaccactggagggttggggagaggatatcggtctgtagccactgaagctatcactaggatggggttttgggggaagggtgtggggggtaccgtgcagctggaagcccctgagttagggttccctgggcagaggggctgacattcccaggttagggaggtgaggtcattgtttgcagcccagggcctgggctagggcacagaggaggtactaggatgtagattccagatctggggaacccaggatgaggtgtgacttttaggggcctgagggcagtgcttacagctgaagggcagctttgggcttggaccgggtcctggggggatgagggggtggggttctaagtctaggagcactcttcacaaccgagaatgccccggggctaggattccgtatctgcgggtccgatgggagctccgtttgtcgcccagggagctcatggtaatttcttgatctggggagtgtctctgcagccaggaaaccccggggccaaggttctggcttgggttcggaagggacactggggtggggtccccgaacttgctatttgcaagttagacacccgggctggagttccgcatctgggcccgaggttgggactccagtctggggtcgctgtccgcagccggggctggtgaccgcaggcctggaggggggcccagaggtcttacctggcgagtagagcgcagccagctcgcgggccccggcgtgctgcgcgccccagcggcaacaagacgcctcgtcctcgtccagctccagctgctggcccggccagttctcggcgcccgccatggccactcgcccgatcggcccggtgcgctctgctggcggcggcggcggcagggccgcggaaccgcggcgagatcacgccgcccaatgaccgcccagcgccgggcgcggcggcggcgcgggcggggtcctcgcccggccgcgcgtcacagccaatcggggctcgcgccggagccgcgcaggccaatcggacgtcgctgagccgcagccaaccgccgcgagccggaggctgggacgcagctggacgcagctgggcgcggaagcttggggcggaggcgcgtgcccgccttcccagctcagccccggcagggctcccggctccagcccactgggagctcgcggcgcgtcgccgcccagctaggcttcggttcacgggcccatgcaatgggccgaggcagggcccagaaatgggcatttcttgagccggcagcgttaagcgcccactgtgtgcaaggaacgcgagggcagggcgccgggctggggccgaggccaggaagcatttggcgggtgctctgtacgatgctccctagcgaggccgatggagagtgggctggtttatcaagccctactgtgtgcagaggtttcgggtgccatgtgttcatcagctgtgtgccagctctgtgctgtgcgcccaaagaggagaaacgtcgagcctgccccgcatcctccccagctcatgttctcccggtggcgaggacagtaaactaatgaaaatgacaactagggtcactatgagatttgctgagcgcttaatatctgtcaggtgctggaccaagagctagacgagcaacatttatttgactcttaaacaccaatggtattgcctcctcagagagccccaccaccaccaccctgctcaaaggtgccccctcctccagtcactgtgacatcaccctgttttgtcttcacagcgcttctggtggggattgagcttgcagtccctgtctctcctatcagagagcaagctcctgagggcagagaacagctttgtttacagcagggcccccgtgccaggatcggggctggaacatggtagaagctcaataaatgcttgatgaatgaattaaggctcagccagatgcgtctaatacttcggcagataaatgacagcagcagggatttaccccaggtctaaccgacaacaaagtatgcaataatttctcatagaaattccatacaggcagccgggcgcggtggctcacgccggtaatcccagcactttgggaggccaaggcgggcggatcatgaggtcaggagatcgagaccatcctggctaacacggtgaaaccccgtctctactaaaaatacaaaaaattagctgggcgcggtggcgggcgcctgtagtcccagctactcgggaggctgagacaggagaatggcgtgaacccgggaggcggagcttgcagtgagccgagatcgcgccactgcactccagcctgggcgacagagggagactccgtctcaaaaaaaaaaaaaaaaaattccatacaggctggacgcggtggctcaggcctgtaatcccagcactttgggaggccgaggccagtggatcacctaaggccaggagtttgagaccagcctggacaacatggtaaaaccttgtctctactaaaaatacaaaaattaggcaagctacttatcccagatacttggaaggctgaggcaggagaatcacttgaacctgggaggtggaggttgcagtgagccgagatggcgccactgcactccaacctgggtgacaagagtgagacttggtctcaaaaaaaaaaaaaatccatacagtgagatcacataggagcctccctagaggctgtggaaggtcctgaaaggtgctgggggagcagagagggaaggtaagatccccttccagaatccaggttctctgagggtttaagtcctggattcctgcactaccagtcaccccagggctgtttcctgagtgttcctaccatagacagccactgtccccacccaggcctatgctccctccgtttctttcccacacctgctcccaggaaggaaaagccaccttccagtggcagggatgggttgcaacccaagtcctggtgaattccggtgaagctggctggttttgcatcagtattaacagcacagttaatccaacagttggattttttaacccaggagcttaaggcttgggtggggggcggcggacgggggggggggggcgcggttggtggctttggtgggggctggatgtcagatttcaggtaaataccttctaaagctctctgctcgtatcccacagcctccaaacagggtagggtggctggttactgctgctgtccagagaccctcacagtggccagcaccagatggttgatggacagactgcctgagataactcattccttcattcattcactgaacatgtttattaaacaccaacctgtcccagggaaacagcagggaatgtgacagaatccctgctttcttgggaggtgggggtgaaggttagggaagtcctgtttaagaaggtgacattggatccaagacctaaaggatatgggggagacagttacttaaaatgagctgggaagtcccttccctgtggggttttgagtagaggaatgacatgatctgacttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgacttttttttttttttgagacggagtctcactctgtcgccaggctggagtgcagtggcacaatctcgtctcactgcaacctctgccccccgggttcaagcgatcctcctgcctcagcatcctgagtagctgggactacaggcacgcgccaccacacccagctaatttttgtatttttagtagagaccgggtttcaccgtgttggccaggatggtctcggtctcttgacctcgtgatctgcccacctcagccttccaaagtgctgggattacaggcgtgagccaccccacccgccttttttttttttttttttttttgagacagggtctcactctgtcacctgggctggagtgcagcagtggcacaatcttggctcactgcagccttgacttcccaggcttaagggattctcccacctcagtctcccaagtagctgggactacaggtgctcgccaccatgcctggctaacttttgtattgttggtagagatggggttttgccatgttgcccaggctggtctcaaactcctgggctaaagccatcctcccacctcagcttcccaaagtgctgggattataggcatgagccactgtgcccagcctatatcttttgtttcatgagatataaatctttttttttttttttttgagacagagtctcgctctgtcacccaggctggagtgcagtggcgtgatctcggctcactgcaaactttgccttccggtttcaagcgattctcctgcctcagcctcctgagtagctgaaattacaggcgcccacaatccctggctgatttttgtatttttagtagagatggggtttcaccatgttggccaggctggtctcgaactcctgacctcgtgatccgtccgtgttggcctcccaaagtgctgagattacaggcatgagccaccatgccccaccaagagatataaatttcataccttttaaagtataaagtgaaccatattaaattccgtggtttttagtatattcacacagttgtgtaatcatcacgactatctagttccagaacattttaagtacccccaaaagaaaccccatatccattagcagttactccctcacttccctctttccccagcccctggtaaccattaatctactttctgcttctaaggacttgcttctactggacatttcaatataatggaatcatataatctataattatatgaagccttttttgtctggcttctttcacttagcataatgttttcaaggttcatccatgttgtagcacatgtcagaactgcacttttttattcttccagtagctcagattacaggcatgcgccatcacgcccagctaatttttttgtatttagtagagacggggtttcaccatgttagtcaggctgattgtgaactcctgacctcaggtgatacacctgcctcggcctcccaaagtgctgggattacaggcatgcgccaccgcgcccggccacgtatatcttttttggagaaatatctattaaaatcctttgccttggccggatgtggtggctcatgcctgtaatcccagctacttgggagactgaggcaggagaatcatttgatcctgggaggcgagtgatccgagtgagctgagaccacgccattgcactctagcctgggcagcaagagcgaaactccatatcaaaaacaaacaaacaaaaaatcaaatcctttgccttttttcaaattcagttattggtatttttcttgaattgtaagagttcttgatatagtatggctattaatcccttatcatatataggatttacgacaattttctctcattctgttggttgtcttttaacttccttgataatgttctttgacatacactttttttttttttttttaaatagggtctcattcttttgtccaggctggagtgcagtggtgtgatcatggctcactgcagccttgaactcttgggttcaggtgattctcccacctcagtcatccaagtagctgggattacaggcagattacaggcatgggccaccacactcagttaattttttgtattttttttttttgagtggagtcttactctgttgccctggctggagcgcagtggtgtgatcccagctcactacaacctccgcctcttgggttcaagcgattctcctgcctcagcctctcaaatagctgggattacagatgtgctccaccacaccagctaattttttatatttttagtagagatgaggtttcaccatgttggtcaggctagtctcgaactcctgacctcatgtgatccaaccaccttggcctcccaaagtgctgggattacaggcgtgagccacggcacccagcccagacttccctttttaaaaaaattttttcttcctcacagggtctctgtatttgtctccctggctggaatgcagtggcaccatcatggctcactgtagcctcaacctcttaggctcaaacaatcctcctacctcagcctcccaagtagcttggatcacaggcacacaccaccatgcctggctaatttattttttgtagagatggggtctcactatgttgcccaggctggtcttgaactcctgggctcaagcaaacctcctacttcagcctcccaaagtgctgggattacaggcgtgagccactgcgcttggcctccgagtggtacatttgttaattgataaacctatattgacactccattatcacccaaagtcaatagctggcattacgattcactcttggtgtacattctgtgggcttgggcaaatgtgtaatgacatggatccaccatcatagttatcagacagagtagtttcactgccctaaaaatcctctattgcagatgtattttaatgatttggctgaatatgtgggctgctaagaagtgggctttgagcccacaggaatttaaaaaaaacccaggccatagcctggcagaaggaccagggggcctcagagagtataccaggctgtgagaagagcctcagaggcaagcagggatggccatgtggtcaggatgtcgggggctcctgagaggctgtgtgtgcccagcagagccacctgttccctgatccagtcactgagcacatctcctcacccccagcagggcttcctacccagcagaaagtgccccaggcagtgctctggccctgttgcgggctttaggccaacaccctcagtgtgtccacctcctgacaagggacaagagtgtggacaggaaggcttccttccctgggggtggggggtgtcctggagggactgatcagaaccagatgttgcctgtctggactgtggcacagctgtccccaaacttcctcttttccacaaaaggttcttttcgaaacatgtgagacatgggcatgtggatatctgttcctggctgccgacatccattcctgctccttcatagaaataataccctgaattggctgggtacggtggctcacgcctgtaatcccagcactttgggaggccaaggcaggcggatcatgaggtcaggacatcgagaccatgctggctaacatggtgaaaccccgtccctactaaaaatacaaaaaaagtagccgggtgtggtggcacgtgcctgtagtcccagctactcgggaggctggggcaggagaatcgctgaacccgggaggtgtaggttgcagtgagccaagatcacactccagcctgggtgacagagtgagactccatctcaaaaaagaaaaaaaaaaatgccctgaagttttggaggaatctctcttgctgcccctgttctcagcccctgaatttagcacaagccaagctacattgtccagtcccctgggatgcagtgattggttcagggatgagcatgtgacttcagatggtctatgacagtggacttcaggatcctggtatggaattgggatgtgaataagaaagcaagtctcatcagaatctgctggcagccatgggggcatcatcctcagggtgagtgcaacattagaggaagcaaaaaggagagaccaagagaaaccaggtccttgctgagacctttaagtgcctggatcaagcttcacctgaaagcagccctacctttccagtcagacagacttaggttaagtctcagctccaccacttgtgtgctgtgtgaccatgggcaaattatttactctctcaggatgtcagtttcctcctgtaaaaatggggatcctagcagagtgccagcttcatagggttgttatgaagataagttaatacatacatagttgttagaagagtgcctggtatattgtaaaccctcaataaattttattttattttatttttttgagacagagtctcactctgtcatccgggctggagtgcaatggctcgatctcggctcactgcaacctccgcctctggggtacaagtgattctcctgcctcagcctctcaagtagctgggattacaggtgcctgtcaccacgcccagctaatttttgtattcttagtagagatggggttttgccatgttggccaggctggtctcaaactcctgacctcaagtgacccacctgcctcggcctcccaaagtgctgggattataggtgtgagccactacacccgccttcaataaattttagctattactgttagcactgagccactggaacaaaccttacctgaactgaaactttcctttgaacttcactgatataggaatccagtggattctgtttttgtttgtttgtttgtttgttttttgagatggagttttgctcttgttgcttaggttggagtgcaatggtgtgatctcggctcacggcaacctctgcctcctgggttcaagcgattctcctgcctcagcctcctgactagctgggattacaggcatgcaccaccacgcccagctaattttgtattttttagtagagacggggtttctccatgttgttcaggctggtcttgaactcctgacctcaggtgatccacctgccttggcctcccaaagtgctaggattacaggcatgagccaccgtgcctggcctggattctgtttttattttgctatattttttcttgcttgcagagtgtggggcctgagatcagggaaggatcagcgagaaaggtgtggggaactgtgtttgaaggtggctattgctctgtggcaggcagtttgcatacaacttgctatttggccccattttccagaaaaggaaactgaggttcagagaagttaagttgtccaatgtttcgtttttttttttttttttttttgagatggagtcttgctctgccacccaggctggaacgcagtggcgtgatcttggctcactgcaacctccgcctctggggttcatgccattctcttgcctcagcctcccaagtagctgggacgacaggcgcccaccaccacacccggctaatttttttgtatgtttagtagggacggggtttcaccgtgttagccatgatggtctcaatctcctgacctcgtgatccgcccgcctcggcctcccaaggtgctgggattacaggtgtgagccactgcacctggccaacttctccagtgtttttaccaaggagaaaaggtaaggtaaggtgccgggtgtggtggctcacacctgtaatcccagcactttgggaggccgaggcgggtggattacttgaggccaggagttcgagaccagcctggctaacatgggaaaccccatctctactaaaaacacaaaaattagctgggcgtggtggcacgtgcctgtgcctgtaatctcaactactggggaggctgtggcaggagaatggcttgaacccgggaggcggaggttgcagtgagccgagatcacaccactgcactccagcctgggcgacagagcaagactccgtctcaaaaaacaaaacaaaacaaagataagggagggaagctggacactgggtatggcaagagtaaacgccaggagatgtgactgtacctggtgtgcatgcagggaatgggagtcattaggaatccagaggaattagcggggaataaaaggccaggaggccaggaagggcggagtccagctccgtatcggtggtggttgaagctatctttgtgttatggccacatcaggggttcccttgcatcaatcttcttatctgtgagggggacatagaggtgcatttgtttggattagatttgactataagccacagatatcccaaagttatagtggcttaaacatggcagacacacacacacacacacacactacacacacacacacacacacgaacatggcagacatttcttttcctttcacataggtataggggaccagaggtagtgtggcagaatccacaatcaccaggccccttctatctggtcactccaccatctggtcggtcaaccaacaggtggcttccacctcagggcccaagaaggttgctcatgctgcagccgttttgtcatattccagccagcaggaaggggcaaagaaggcaacacttccctgctttgatcccactggttagaacttggtcttagtcacatggcactctctgctgtacaggaggctggagaatgcagttgtcctctgcggagaccaacttaaaagctggggttctattaataataagaaaggaaaatgatattattaatagttgatactcggaagcttctgccacacacatggcaggcacgagtccttctttttggcctccagtgtatgaactgctttcctaggctctctagccattgtggtgttcctgagagttccccaattatttccctagtagattacttgtttcttgcctgtcatcgtgagccctcatagtgaatggcataggggacaagatcagaaatgcctgatcaacaataacggtgagcatttattgagcacgtactgcacgccaggccatgttataaccttacttcagcctcccgagtagctgggattacaggcatgcgccaccacgcctggctaactttgtatttttagtagagacggggtttctccatgttggtcaggctggtctcgaactcccaacctccggtgacccgctcgcttcggcctcccaaagtgctgggattacaggcctgagagccaccgcacccggccggacctggttcattttaaaattgttgtcttaatcttagttgcttaactgcttgcaattctgtgtgttggctggtggttcctctgtgggcttcccctgggcttgtgcatgcggctgcttctggctttcagctgtgctggctgggctaaggtggcctcattcatggtgacatgggattcagatgggatccagatgggattcagatagcagctgattgttggctggggcacctctgtactgcatctgggctctcatcatccagaaggttagactggcttctgtacgtggtgttttcagcacagcatccaggagccctaggcccagatgtcccataaagtctctttctcccatttattctatctcaaagcaagtcaaacaccagcccagggcttccaggaaactgctcctcgctccttgttggcccacagacttcatttgtactcactagcagagggataagattactctttgactcatccggccctccaaggcagggcagggaatggggtcacttacctaaggcacctgggttgcctggggaagggggcaagtgcagggagagggtggttacagagggacacaatagacaataggaccatcaccacccactgtttatgttcggtggaatttctttccaggcattttacaaatatacgcaagagatcttcctgcctgccacacttatactgagaacctttttctggaagcctcttgggactgtgccctaattgtgtctagatccagggcacaatcatacaatgatgtttttccttttcctgggagcaggtgggaatgacagattaaaacttgctttaaaaactagaacaaaacataggtgagtttctaaaaaaatgcctttaaaaataataattcaattttttttcaaatttacagaaagttgcaagaatagtacaataaactctcaataccctaattatcaacattttgctacacgtgatttatccttctttctctccatgtgtaccattttttcggaaccatttgagagtcagttacagacataatgcctttttaccctaaattcttcagtgtgtatttcttaagaacaaagacattatcttataggaactctatagtttttaaaatcagaaaatgtcacattggtgcaatgctataatttaacttcttttctttcttttctttttttttttttttttttgagatggagtttcgctcttgttgcccaggctggagtgcaatggcgtgatcttggctcaccgctacctccgcctcccaggttaaagcaattctcctgcctcagcctcccgagtagctgggactacaggcacacgccaccacacccagttaatttttgtattttttttttttagtagagatggggttcaccatgttggccaggatggtctcgatctcctgacctcgtcatctgtctgcctcggcctcccaaagcagtgggattacaggtgtgagtcactgcgcctggcctataatttaatttctatcgttcagattcaaatctcgttatttatcccaattaggaactgagacccttttttttttctctgagtctgcttgcaagggacatctcttattcttaaactagtgactatcaatgtcattgcaccccttctagggaggtaaaatgtccttctgcccaaagagaagaaagtcaataacacataaaacctgtttaaagaatctgtgcttagaaatcctcctcgtaggccaggcgcggtggctcatgcctgtaatcccagcactttgggaggccgaggcaggtggatcacctgaggtcaggagttcaagactagcctgggcaacatggtgaaaccccgtctttactaaaaatacaaaaattggctgggcgcggtggcgcatgcctataatcctggctactcgggaggctgaggcaggagaatcacttgagcacaggaggcagaggttgcagagagctgagactgcgccactgcactccagcttgcgcgacacagcgagactctgtctaaaaaaaaaaagaaaagaaaaagaaatcctcctcatcctcataggctctgtacagttacagcaatggttctcagttgggggtgattttgactcccaggggacatttggcaatgtctggagaaatttttggttgtcacaactggaggtggtgatttactggcatctattgggtagaagccacggatgctgctaaacatcctacagaggacggttcccccgctgcctgacaacaaagaatgacccagtccaggatgtcaatggggccaaggttagaaatcctgacctgtaagtaaactgaagaggcatgcctttttctgttgcaatggagctcccgtggatctacaattcaccccagcaattccatttccccccacctatgtcacaaaatcccacctctgtaggcacagggaggtccagccaagtgtgtttaggatcgctggaaactggaaccaacctgcatgcccgttaggaggagacagatcaagcacgtagtcacgctgcgctgtgttgcttccctccgcttcttttgctcctgggtaaatagggcgggggaggtgagattggaaggatgccaggaatcttgggcccagctgctgctttatgacttagggatataactgcttctgactcatgcgtgcttggctctttgtgattatgtgctgagacacgtcagcgggaggctgccccggaatgtctccccatgcgaatcgagggtggggcctctgctgagtcacctctggctcctagaagcctggctcagggtcagctcatttgaaaagcggctgccttttcttcttttctcttctcttctctttttttttctctctctctttcattcacattatagcttgagtcagaacttcattcctttttaaggctgaaggaccacattttgcttgtttgttcatgtgatcgatgatgatggacacttaggttgtttccactttttagctatcgtaaacactgttgctaatggaatatgggtgtacaaatatttcttcaagatcttgctttcaattcttttgggtatatacccagaagtggaactgctgcatcatatggtaatttctgtgtttaatttgttgaagaactgccatactgttttccaggttggctgttccatttttaaattttatttatttatttattgtttatttgtttatttttttgagacggagttttgctcttgttgtccaggctggagtgcagtggcgtgatcttggcttattgcaacctccgcctcccaggttcaagccattctcctgcctcaggtacccaagtagctgggattacaggtgtgcgccaccatgcccagctaatttttgtattctagtagagacaaggtttcaccatgttggccaggctgatcttgaactcttgacctcaagtgatccacctgcctcagcctcccaaagtgctaggattataggcgtgagcctccacgtccggcctggctgttccattttatattccaacagtgcacaagggttccaatttctctacatcatcaccaacacttattattattattattattttggagatggagttttgctttgtcacccaggctggagtgcggtggcgctatctcagttcactgcaacctccgcctcccaggttcaagcaaatctcctgcctcagcctcccgagtagctgggactacaggtgagtgccaccacgcccggctgattttttgtatttttagcagaggtggggtttcaccttgttggccaggctggtcttgaactcctgacctcaggtgatctgcccaccttggcctcccaaagtgatgggattacaggcaggagccaccaagcctggcctgttttgtagttttcattgtacaagtttttcactttttggattaattcctaaggattttcttctttttgatattattgtaaatgaaattgtttttataatttttgtttcagatcactcactgtcagtgtagagaaaagtaactgatttttgtgtgctgactttgtatcttgctactttgctgcattcatttattaattctaacagttttttcttagtttgtgaaatctttagggtttctacatataagatcatatcattggagagcagagattattttacttcttcctttccgtttggatgcctttgatttctttttctttttttttttgagatggagtctcactctttcgcccaggctggagtgcagtggctcgatctcggctcactgcaagctccacctcccgggttcacgccattctcctgcctcagcctctcgagtagctgggactacaggcacccgccaccgcgcccagctaatttttctgtatttttagtagagacggggtttcaccgtattagccaggatggtctcgatctcctgacctcgtgatccacccgcgtcggcctcccaaagtgctgggattacaggcgtgagccactgcgcctggcctgatttctttttcattcctaattgctctggctagaactaccagtactatgttgactagaagtcaacatagggtttttttttttttgagacagggtctcactctgtcacccaggctggagtgcagtggtgcgatctcagctcactgcaacctccacctcccgggttcaagcgatccacccagcctcccaagtagctgggacaacaggcacctgccgccacgcttggttaatttttttttgtagagatgaggtttcaccatgttgcccaggctggtcttgaactcttgagctcaagtggtccgcccaccttggactcccaaagtgctgggattacaggcatgtgccactgtgtccagccttgggcagccattttggaccataagatgaaaactgccagttgtcttcaacaaaaagagcgcaagatagcaaaagactgggttcctgacaccgtaaagcaactatgcagctctggatcactttcattcagattaatatgagagaggaaaacaaactactttttgactaggaggcagttgttatttgaacctttcttacagcatggagcctgtatcccaccattgtagtttgtctaatgaataaatggatgattgaataaccaaagaagcagtcagatccaggcccccatacagattcatgcacaaagactctgccttagcctaggtgggagcaacgtccaggtgcagtagaaatattcatggctggaggctagttctttctgacacagggtctcgctctgttgcccaggctggagtgcagtggtgtgatcacggctcactgctgccttgacctcttgggctccagcagtcctctcacctcagcctcctgagtagctggaactacagatgtgtgccaccacagctggagatatatatatgtattttttatagagacatggtctcactatgttgcccaggctgatctcaaactccaggattcaagtgatctgcccaccttggtctccaaaagtgctaggactgcaggtgtgtaccaccgtgcctggctgattttttttctgtattttttttaacgacaaggtctcactctaccaggctggtctcgaactctttggctcaagtgatttgcccaccttggccttccaaagtgctgggattacaggtgtaagccaccgcgcctggcccagaggagctagtactactagttctaaatctggcctttccactagctagctgtgtgcccctgagccacccatgtgccctctctgggtctcacatttctcagttgtaaacccggcttagcaaatctttaaatctatgcaatttaaagttatttttgctcttttgcaattgcatttctaggaatccattcccagggaaattctcaccacatagcacatgaacacaggtgccaggatgcagctgcaccttcctttgtggagcaaaaacttggaaatatccttaaaagtgattaagtaaatcagagtatgaactgtgctctggagtgcaagaccgcggactatggctttctggattctctggtgacacctgctggcacaaagggatactgcagcccagcttggttacgtattgggaatttctagaagaagagaggttcggggcaattgtgtgagggtggtttgggaaggcacagagcagggagagatttggaaggaaggtcaaggcaaggaggtggcctgggtgtggaggttgcaagcatagacttgggttcaaattccagcttcactacttactagctgggtgagcctgggtggatttgggactttctctgagcctcactttcttcttctgtaaaataaggattctgggccaggtgcggtggctcatgcctttaatcccagaactttgggaggctgaggcgggcagatcacaaggtcaagagttcgagaccagcctggccaacatggtgaaaccccatctctactaagaatacaaaaattagctgggtgtggtggcgtgtgcctgtaatcccagctactcgggaggctgaggcaagagaatcacttgaacctgggaggcagaggttgcagtgagctgagatcacgccactgcactccagcctgggagacagagcaagactctgtctcaaaaaaaataaaataaaataaggatcctaaggcccgtgttacagattattggtgagggctgggtgaaagaactaatttatttaataatttattgaaacaacatttcaataaagatgtcagtgactgacaatctcatctaggtgccagggatacagcaggggatgaggcctgggtcctgccctcctggagcttacagtctagtgcagagaacacaacaaaccaataagcatgcatgtgatataatctcaggtattatttttatttatttatttatttttgagacagagtctcagtttgtcacccaggttggagtgcactggtgccatctcagtcactgcagcctccacctcctgggttccagtgattctcatgccttggcctgccaagtagctgggactacaggtacacaccaccatgtcggctaacttttgtattttagtagtcggctaatttttgtattttagtagagatggggtttttccatgtcgcccaggctagtctcgaactcctggcctcaagtaatttacccacctcggcctcccagtggcgggattacaggcgtgaaccaccgtatccagcctaatttcaggtatttatgacactacaaacgaaaataaagcaggaggcgtgctggtgtgggtggaggcattgttacaagtggggtgtgtgaggagggcatctctgaggaggcttgagcagagccagaggagccgtgtcgtgtgtgtgtatggaatgcatgagaaatgctagtggaagagcctcacacataggaaagggccaataaatggtgggtcatcatcttattacacacagcagagggaacgaaaggaagagggattggaatccgtttcccagggtctgcggcagtcacagagagtgacagaagattccctgggctggcaggtggagcagcagccctgctcatggtgtggggggtggggagccctggacctgaggagacccagctctgggtggccttgggtgagccactctctgggcctcagtttcctcatttggaaaacagggccgataatgcccaccttgtgaaactggggggtgtcacaggctgaatgatgacctcctccaaataattatgttgagattctaacccccagtacctcagaatgttactgtatttggaaataaggcctttaaaggggtaattaagtggccaggcacagcggctcacgcctgtaatcccagcactttgggaggtggaggtgggcagattacttgaggtcaggaattcgagaccagcctggccaacatggtgaaaccctatctctaggaaaaatacaaaaattagctgggcatggtggtgaacatctgtaatcctagctacccggcaggctgaggcaggagaattgctggaagccgggaggcgggagttgcagtgagccgagatcccgccactgcactccagcctgggtcacagagtgaagctccctcttgaaaaaaaaaaaaaggtaattaagtaaaaatgaggtcattagggtggaccctaatccaatataatcgttgtcttcataggaagaggaaatgtggacacagacacaaacagagggagggccatgtgagcccagagcaagaaggcggccatctacaagccccggagcgaggctgcgggagaagccagccccgctcacaccttgacaacaatctctgttgattaaaccacacagtctgcagtcctctattacggtgagccctgccagctgagatggggttgacgtgggaatacagctgggcacacaggaggccctcagtggaggctggtttctttggcccagtgccacatggagcccgtccactggctgagctgggggcctgattgtggccactcaacgtctctgtaaagctcagggtctgccttgagatcctgcacttaccacggagtggccctgccttggggacccatctcacctcacttctgccctcctttctggttcatgactcagccatccactaacctcccgtggtagcactgtggccactctgtaaacgacagcaccactggtgtctcattgggggccagtctggaagagggagaccaccctaggcatttcagacagaagggatggaatacaggcattgcttacacagaggacggacgagccgagatgcagaaaggccaggtgaagcattggccacagctggaggcgctccaccctaggccagcgggacagaaggaagctgggtccgagaagccagggcttggagccacagtgggggctgcctggtaggagttgaccagggagggagggtctgtcgggcgggggcgggggctctttgccttccgatccaagctccgccctctgcagctctgctctgtgtatcccagagctgaccctgcggcgcctttcccaggctcgcgtccggtgagttcctattggccaacgggaggccccggtcggggagcgccccgggacaggcccctgtgcctcccgctttgcggagtgacgcaggccctgggctacagcaaccttaccagcccctccagcttagaggtggcagtggctctctgcggctgcgatttctttctcggagcgtcctccccatcccgttcggcctctgcctccaccgtcgtctctgtaacccgttccctgtgggagagtctctgttgcggtgttcaggggtttcggttttctggctgaacagtgattaacgcgagggaaggcgctgacggcaaggtggcaggtgaccagcccagcaggccgcccagcccttcccttcctacagacagaagcactgaggcctgcagaggggacaggcaggtgggcgtgggggatcgggggcagccctggagtcagacaggccttgttttgtcccaggaagaacattccaacacagaccacaacacctatggacctggaaaacattgtgctcagtgaaagaagccagacacagaaggacaatgttgtatgaggtacctgggatgggcagattctgagagatggaaaatagaatagagattacctggagagaggggggaattgttgaatgaggacagagtttgtgttggggatgatggaaaagttttggatacagagagttatgacgagtatacagcattgtgaattttttttcttttctttgttttttgtgacaaggtcttattctgttgcccaggctggactgcagtggtgcaatcctagctcactgcagcttcgacctcccgtgctcaagtgattttcccacctcagcctcccgagtagctgggactacaggtgcgtgccaccacgcctggctgatttttcttgtatttttttgtagagatgggggtatcgctatgttgcccaggctggtcttgaacacttgggctcaagtaattctcccgccttggcctcccaaagtgctgggattacaggtgtgagccactgtgcctagtgtgaatgcatttaatgccactgaattgtacacttaataatggtgaaaaatataaatattctgttaaatattttaccacaataaaaaaatgtgtgacagttgtcagaatcaaaatggtgtcactaatgtttttttttttttttttttttttttttttgagatggagtctcgctctgttgcccaggagggagtgcagtggtgcgatctcggctcactgcaagctccgcctcccagcttcacaccattctcctgcctcagcctcttggagtagctgggactgcaggcacccgccaccacgcccagctaattttttgcatttttagtagagacggggtttcatcgtggtctcgatctcctgacctcgtaatccgccctcctcagcctcccaaagtgctgggattacaaacgtgagccaccgcgcctggcctggtgtcactaatgttaagaaaaccttcacaaatagaggcagaccatgaagagaggggtctcattcttatatgcctgataaagaaagactttaagaactacaacccttggcggggtgcagtggctcatgtttgtaatcccagcactttgggaagctgaggcaggtggaatacctggggtcatgagttcgagaccagcctggccaaaatggtgtaacactgtctctattaaaaatacaaaaaaaattagccaggcgtggtggcaggcgcctgtaatcccagctactcaggagactgagtcaggagaatcgcttgaacctgggaggtgaaggttgcagtgagcagagatagcaccactgcattccagcctgggcaacagagtgagactctgtctcaaaaaattaaaaaaaaaaaaaaaaaagaagccgggtgcggtggctcacgcctgtaatcccagcactttgggaggccaaggtggatggatcacatgaggttgagagtttgagaccagcctgaccaacatggagaaaccccgcctctactaaaaatacaaaattagccaggtgtggtggtgcatgcctgtaatcccagctactcgggaggctgagacaggagaatcgcttgaacccgggagatggaggttgcgatgagctgatagtgtcattgcactccagcccaggcaacaagagcaaaactctgtctcaaaaaagaaaatatttatttttagagacaaggtcttgctctgtcaccgaggctggagtgcagtcatagctcactggagccttgaagtcctgggctcaggcagtcctcctgcctcacctcccaagtatctgagactacaggcaggcaccactatgtccagttaatttttaaattttttcatagagatggagtctcactatgttgcacaggctggtcagtctagacaattttaaattaaatatgtaactcacattaacaggtcacattatttatttatttatttatttatttattgacacagggtctcgctctgttgtccaagctggagtacagtggcacaatttcggctcacagcaacctctgcctcccgggttcaagcgattcccctgtctccgcctcccgagtagctgggattacaggcgcccaccaccacgcccggctaatttttgtatttttagtagggacagggtttcaccatgttggccaggctggtcttgaactcctggcctcgtgatccacccgccttggcctctcaaagtgctgggattacaggcatgagccaccatgcccaaccgcagacatctttttgttttgtttttttttctttttttttttctttggagatggtgtctcgctctgttgcccaggagggagtgcagtggcatgatacctgctcactatagcctcgaactcctggattcaagcgatcctcccacctcagcctcctgagtagctgggcctacaaatgtgcaacaccacgcctggctaattaaaaaggtgacagagagaccctgtctcaaaaagcaaacaaacaaaaaacgacacatgtgcgtgtgtgtgtgtgtgtgtgtgtgtctgtggagagagagagagagaaagaaggagaatatgatacatcaaatgtagtaaaatgaaaacatttgggaaatatttgaagtatttgtaacttttctctaagtctgaaagtatttcaaaattaaaaaaaaatttaaaaggtgaatagtgccaggtgtgttggtgcacgcctgaaatcccagcactttgggaggccaaggcaggtagatcacctgaggtcaggagttcgagaccagcctggccaacatggagaaactccgtgtctactaaaaatacaaaaattagccaggcatggtggtgggcacttgtagtcccagctactcgggaggctgaggcacgagaattgcttgaatctaggaggtggaggttgcagtgagctgagattgcaccactgcactccagcctgggcgacagagcaagactctgtctcaaaaaaaaaaaaaaaaaaaaatggtgaatagtaccaagcggtggtggaagatatgggatataaaacccttgggcacagctggtgtgagtggagacgggacagcctttctgtagagcacctggtacttagtcaaattagtccccccatcccctacaacctactctcaagccaaagtcccagagacatcctcacaccagccctagagggtgcaaggaggtggcagctcaccttatctgtggtggggcaggttgggggtcacttgggtgtctaccccagggactgggcggctgagactggggactgctcatagaaaggaccgtggatgagccacagctacaaaacccttcacacaagtgttcatgccacaaagtagccacatgtgttttgcagggacacattccagcaaaaagacacaaagtgacagaatggctgcctttgagtgggggtgagaagaggtggatggcaggtaccagaagagaagggaataaatatatgaagaaatacaaccccctcgggcagtgcctggcacagcataaatgcccaggaaaaagaggcccagttgcttacgttcccggcgacagggccgggaccagcgccggcttcctggtgaaggaggccaccctttcctcttgaggggtctgagtatgcatgtcagcacccggtgggcacccagcacccagctgaccaggggccttcacctctgtgggggttaccggcctggccctgagaactggatgaaagctggaataattctttctgtaataaagcaaacgcaaccacgttcaacctttcccttcatttcagaggcttcccgcacctgatgcctcccacagcctcaggctgagtccccaggtgctccagtgggggtggcaaagctgagcactgagttggtttccatagttttcatcattaaaatgtttaaatgactaggccgagcacagtggcttctcagcattttgggaagccgaggtaggcagatcgcttgagcccatgagtttgagaccagcctgggaaacatggcaaaatcctgtctctacaaaatgcaaaaaaattagccaggtgtggtggtgtgtgcctgtagtcccagctacttgggaggctgaaatgtgaggattgcttgagcctggggaggctgagattgcagtgagccgtgattgtgccactgcactctagcctgggtgacagagtggcagaccctgtctccaaaaaaaaaaaaaaaaaaattagcctggcatggtggtgcgtgcctgtggtcccagctacttgggaggcagaggagggaagggcacctgagtctgggggtgttgaggctgcagtgagctgtgatggtgccgacgtacttgagcctgggctacagagatcttatctaaagaaaagcctaaatgaatgtgtggtgaggagcaggcttgagttattttcatgatgagctcctcaggatagattctcaaaagtggcattggtggggctctacctctgtttattcattaatctgttttatttttatatttatttatttatttcagttatttttttgagatggagtttcactctgtcacccaggctggagtgcagtggcacgatctcggttcactgcaacatccctctcccaggttcaagcaattctcctacctcagcctcacaagtaactgggattacaggcgtgcgccaccacattcagctaatttttagtagagacgcagtttcaccatgttggccaggctggtcttgaactcctgacctcaagtgatccacccgccttggcctcccaaagtgctgggattacaggtggcagtcaccatggctggcttgttttatttttaacatttaattgggtaagctgcagatacccctcaagatgtcagtgtgcatgtcaagatgtcagtgtgcacgtcattaactagagtcaaatatttgtttctctgtctgtaaagcttacatttggtgaactgcacctttaggtgtacttttgattattattattatttttttgagatggagttttgctctgtcaccaaggctgagtctagtgttgcgatctctgctcactgcaacctctgcctccagggttcaagtgattcttctgcctcagcctcctgagcagttgggattacaggcgcctgccactgcaccaggctaatttttgtatttttagtagagatggggtttcaccatgttggccaggctggtcttgagctcctgacctcaagtgattcacccgccccagcctcccaaagtgctgggattacaggggtgagccactgcgcccagccacttttgattacttttgacaaatgcatccacctgcactgcccaaactccctccaagatgttaaacatgcagtgggttgaattgtgtcccccaagaagatatgttcaagtcctaacccctgggacctgtgaatgtgaccttatttggaaataggggcttgcagatgaacccaacttaagatgagatcattctggattgtgggggctctaaatccaatgactggtgtttatataagagaaaggagagggagatttggaggtgaacacacagagggaagaaggcactggaagaaggccgttggaagattaaggcagagattggggtgaggcagctagagccaaggaacatggtggatggcgggcaagcaccatggaagaggcaaggagggattcttccccagagcctccagagggagcaggaccctggtttcaggggagaataaatttctgttgttttgggtttgtggtatcttatcatggcggccttaggaaactcacacgaaacacacaccatcaccccagcgagcacccttgtcccctcctcagttgtgctctcccccaactggcaaccaccgtgctgatattttcctcatgggtgagttctgcctgttctagagctctaaacagatgggatcacacaggaagttcttggcatctggcatctttcactcaaacaagatttcagagattgttgcagctatcagtgctggcacgcctataattaaagtccatttacttgaagaggaagtaaattttgaatttgaggaggggagtaggcagtaagctttctttttttttttttttttgagaccgagtttcactctttttgcccaggctggagtgcaatggtgcgatctcggctcaccgcaacctctgcctcccgggttcaagcgattctcctgcctcagcctcccaagtagctgggattataggcatgcaccaccacaccgggctaatttttgtatttttaatatttttgtattttgtatttttagtagagacgggggtttcaccatgttggtcaggctggtctcgaactcctgacctcaggtgatctgcccgcctgggcctcccaaaatgctgggattacaggcgtgagccaccgcgcctggcctgtaagctttctctttaaagctgggcttgaggccccctctcccgggggtctctggccctcaggaaccccagtctgaagctgtttcccagttcagaggttgcagagatcggaggcggggctcccgcgccaccttgtggccattctaggcagcgcaacccatgatgcctgtggcggggcgtgggggtggggtggggtgggttggggaaggtgggttgggcaaatgtgtattttcctggtttgggccctcaagtcactgagcacctactcagcacctgcatgattccactgtatgtgtgtgtggacagagatgaccaagattgcgcagaccctagaggggttcccaggagagggagactacacaacactaactccagtagggtggatggagtgaggcccagaggcctgaagtccagctggagcctggaggaggggagagtaacggacttgggcattcagggaacgtttccctgggcatttcgacagctggggatggaaaggaagactgttacaggcaggggaacagcacaaccaaggtgtggaagcaggaccgggcaacattctggacccaaccaatcataaggtcatacgtgtccatggcaaacattttttttttttctttttagagacaaggtcttgctccatcacccaggctggagtgcagtgacacagtcatggctcactgcagccttgacctctcgggcccaagagatcctcctgcctcaatctcctgaatgtctgggactgcagatgcgcaccaccatacctggctaattttggatttttttgtatagacgggggggtctcgctatgttgaccggcttgtcttgaactcctggcctcaagtgatcctcctgctttggcctctcaaagtgctgggattataggcgtgagccaccacgctaggccccatggtgaattgagttttttttttttttgagacagggtcttgttctgttgcccaggctggagtgcagtggctcaatcttggctcactgcagcctctgctccccttcctgggctcaagtgattctcctgcctcagcctcctgagtagctgggattacagggtcgtgccactgcgcctggctaatttttgtatttttagtagagatagggtttcaccatgttggccaggccggtcttgaactcctgacctgaaatgatccacccgcctcggcctcccaaagtgctgggattacaggcgtgagccaccgcgcctggctggcttaagtcttaagcagcagcttccacttttgtgttctgggggaggccagcagctgtgtaagaagtctgtgctggttgcaaaaagtgcaaggtttaaaaaaaaaaaaaaaaaaaaaaaagactgtgctgaggagaccacatggaaagggcaagagaggccaggaggagaggctacttgaagggacaacttgcagcatgtgcagaggccacatggggagaaagaaactgccagagggagcactgaggaatgaactaaggcagcagacacatggtccagccagccatccgccactcgggccagccgtgaggtgccacacgtggagcacagaagccactgtggacgcttggagcagagataagccgtcccctcatgctctgtcctaattcctcacctacaggatcgtgagcaaatatactggtggttattttaagcccttaaaaaacagaattactggccgggcgtggtagctcacacctgtaatcccaacactttgggcggccgaggtgggtggatcacttgaggtcaggagttcaagactagcctggcctacatggcaaaaccctgtctctactaaaaatacaaaaattttttattttgtatttttagggcgtggtggcacacacctgtaatccagctatttgggaggctaaggcatgagagctgcttgaacctgggaagtggaatttgcagtgagctgagatctgagatcatgccactgcactccagcctgggcaacaaagtgagactctgttttgaaaaaaaaaaaaaaaaaaggcattactatataatccagtaaccccaccactgggtatatatcccatggaaatgaatctagtgtgttgaagaaatatctgcgcttgcacatatcctatggaaatgaatctagtatgttgaagaaatatctgcgcttgcacggttattgcagcgttattcactaagttttgaggtgcagtgttacatggtggcagccagaacccccggccctgggctactactgttgctggtttcttatgacccttccagcatgagcctctgcatcctcaaatacatgaagctgggtgcggtggcgcacgtctgcagtcccagctactcaggaggctgaggtgggaggatcgccagacccaggaatttgtgtgctatgatctccctgtgaacagccactgcagtccagcctgggtgatacagtgagaccctgtttctaaacagataaacaaaccaaaaagaatacgtgagtacatttccactcctcccctcatttatgtggggttcgcacaccacacatccggcctgctcttggcttttattttttttccaattaatgatagatcttggagattgttctagatgtgtactgttcaatatagtagtcgctagtccaggaggtgatttaaatgtattttaaaagattaaatttttatgtattttttaaaagtagagcactcctcctgcctcagcctcccaagtagctgggactacaggcacacaccaccatgaccggctaatttttttttttttttttttaagatggagtctcactctgttgcccaggctggagtgcagtggcatgatctcggctcactgcaacctctgctgcccgggttcaagtgattctcttgcctcagcctcctgagtagctgggattataggcacctgccactgtgcctggctaatttttgtgggtttttttttttagtagagatggggtttcaccatcttggccaggctggtcttgaactcctgacctcatgatccacccgccttggcctcccaaagtgctgggattacaggtgtgagccactgcacccagccttaatttaaatttaaatacaattcaataaaattaaaaattcagttcctcaagtacactagccacatttcaggaattcaatagacacacatggctgatagctgccgtatgatacaacccagatagagaacatgtccatcattctagaaggttctcttggacagtgctggtctaagtcctctcccatggagctacctcattcttcttagtgttctttggtaatgacagccactgacgttacctcacaagcttttgctattgcaaagcatttgctgttctccatttttctttaagcaaatgtgagtgtcttggtggcataaatgccttgcatttctgggtccagtgacatttcccattttgtttttttcctttttttatattttgttttattattttttaaattatactttaagttttagggtacatgtgcacaatgtgcaggttagttacatatgtatacatgtgccatgttggtgtgctgcacccagtaactcgtcatttaacattaggtatatctccaaatgctatccctacccccttcccccaccccacaacaggccccggtgtgtgatgttccccttcctgtgtccatgtgttctcattgttcaatttccacctatgagtgagaatatgccgtgtttggttttttttgtccttgcgatagtttgctgagaatgatggtttccagcttcatccatgtcactacaaaggacatgaactctcattttttatggctgcgacatttcccattttgatgggcatggccagattagaactggaggttacgccacttcgcacaaagactgaagctgtaagagtgcctgtttttccacaccatcaacactgcgtgtcattcacattttaaaaacgttttagctaatggcaaaggttttcaagacaaacgtgactttaccaggcccctgccctgcctgttgcctctcaagtcacaatgccagtggacatctttctctgtccacaggtgaagatccatcttttgtttgtttgttagaaatgagaggccgggcgtggtggctcatgcctgtaatcccagcactttgggaggccgaggcgggtggatcaggaggtcaggagatcgagaccacggtgaaactccgtctctactaaaaatacaaaaaattagctgggcgcagtggcgggcgcctgtagtcccagctacttgggaggctgaggcagaatggcgtgaaccaggaaggcggagcttgcagtgagccgagatcgcgccactgcactccagcctgggcgacagagcgagactccgtctcaaaaaaaaaaaaaaaaaaaaaaaaaaaaagagatcttactgtattgcccaggctggtcttgaactcctgggctcaagggatcctcctgcctcggcctcccaaagtgctgggattacaggtgtgaaccactgcgcctggcccacgttggccttttttttcaaattgtaaaatacgcagaacataaaacttaccatattaaccattttaagtgcacagtttggtgccattaaggacattcacgctgttgggtaatcgtcaccaccatccatctccagaactctttccatcttcccaaagatggaactctatatccattaaacaagaacttcctcctacctcagctcctggcaaccactgttctattttctgtctttatgaatctgactactcaaggcacttcatgtaagtggtatcatgcagtatttgtccttttgtgactggcttatttcacttagcacaatatccttaaggttcatccgtgttgtagcctgtgtcagaatctccttactttttaaggctaaataacattctattgtacagacacatcacattttgtccattcgtccatcgatggacacgggtggcttccacctctttttttttttttttttttttttttaagtcggcgtcttgctctgtcacctaggctggagtgcagtggtgcgatctcagctcactgcaacctctacctcccaggttcaagcgattctcctgtctcagcctcccaagtagcagggattacaggcacccgccaccacacccagctaattgcttccaccttttggctattgtgaagaaggctgctatgaacgtgagtgtacaaatatctcttcaagatcttgctttcaattcgtttggatacacacccagaaataaaattgctgggtcatttggtaattctatttttaattttttgaggaacagccataccatttcccacagtagctacacaagcattccagtttctacacatccttcccaacgcagcagccagcctaatgggcgtaaggtggtatctcattgtgttttattccttttatttttagttgacacataattgtacatgttcatgggttacaaaatgatatttcaatacatgtatacaacgtgtaataatcaaatctgggtaattaggatatccattacctcaagcgtttatcatttctttgtgtcgggaacattcaaaatcctctcttctcattgcgttttgtttgttttttagatggagtctcactcagttgcccaggctggggtgcagtggcgtgatcttggcttgctgcaacctccacctcccaggttcaagtgattctcctgcctcagcctcccaagtagctgggactatacgcacgtaccatcacgcccagctaatttttgtatttttagtagagacggggtttcaccgtgtcggccaggctggtctccaactcttgacctcaggtgatccaccaaagtgttgcgcctcattgcagttttggtttgtatttccttaatggttagtgatgttgagtatcttatcatgtgattattagccattcacagttttctctggagaaatgtttattcaagtcctttgcccatttttaattgagttgtttttattgctgttgagttgtaacagttctttatgtattctggatatgaaccccttatcagatatatgatttgcaaatattttctcccattccatgtttccatgttccatttttttttttttggaggcagagtcttgctttgtcacccaggttggagtgcagaggcacaatttcggctcactgcaacctccgcctcccgggttcaagtgattctcatgtctcagcctcctgaatagctgggattacagatgcacgccaccatgcctggccatttttttttttttaatttttagtagagatggggtttcaccatgttggccaggctggtctcagactcctgacctcaagtaatccacccacctcggcctcccaaagtgctaggattgcaggcatgagccgctgtgcctggccagcccccactatttctatgacacaaattcctgctactctccgtcatcaccacaactacgtgctcctacctcagggcctttgcacttgctgttccctttgtgtggtccaaggtcccccagatacctgcttcaccacattcaggtttttgcttaaatgtcacctcagtgaggtcttccctgactactctaacataaagttaaaatcaactcccccagcttgggcaatataatgagacctgatctctacaaaacattaaaaaatcagctgggtgtggtggcatgcccctgtggtcccagctacttgggaggttgaggtgggaggatcacctgagcccaagaagcagaggctgcagtgagcagagatcgtgccactgcactccagcagtgagaccctgtctcaaaaaacaaacaaacaaaaaaccccagaaaacaaaaaatcaaatctcccagaactcctgctctgctcccctgctgtattttcctccatagtgctgaccagaatctaatacaatctatactttaatcattgatcttgtttagtgcttgtcttcccccaggagaatttcagctccacgagaacaggaattgcttgtcttgtccatgaatgtgtctttagggccagaattacagcatgtgccaaggaacattcgataaatgtgaaggttgagcactgttttctgttcgttggacactctggttcctctcggcggcctgctgatgccctgtgtgcatctatcacatccatggcaccggcctttcctgatcccagagcaagggcgcccagcggatcttcacgcatgtgaatggctcctgcagtcccagaacctgccacctgggggcagtatatactcaggcaagtttcactaccggtcctgagcacctcccgtctccaaaatcctggatctcagaacctcggagcctggcagcccttggggatctatctctgccagccccacttggcagatggggaaactgaggcctcagagaggaggcatgatggggaaaatctcaaacattggaatcagggaatctggcttttaagtctggctcttgtacccattcacaagggtacaagggggatttggagggggaagtaggaagttctaatcctcttcgggcctcagtttccccatctgcctgctttgtggggtgaaagggacatctgattaactctaatgtgtcggggaaggccagcagtgaggggtaacagcaggcccagaatcccagatagaatattatcacctcattttatataccagggactgaggcccagaggggacaccagacacggccggagagccacagcatggaaggcacagggcagcatgaaaggccatccccctgccatccccctgccccacgcccactagagacacccccccattcatgttctgatggttcacctctccgccatattttcccacctgctggctgatttctaagcccttttgcagaacactctctgtcaaagcagccacgtggatctccccttggcaaatcgcctcagttttctcctcttgaaaatgggatagggaaaagctgcagagatggggaggaggaattgtgaaaagcagtttgggggcagaggaggacgtgtgtcccaggtaggaaagtgcctgttccctccccgcccccgcctggctcctgcccaccaccatgtggccacgtgggcccagcccacagcttcaggttttaaaagaggagctggaaatttgaattttgatgtgaaatctcctgatttttaaatgttggcaataaattcacttaaacacacacacatcaagcaaaacgctatggggtcaaattgaacacatctgtggtctcgatttggccactggctgccagtttgagatcctttccggctctaggttctgagggcaggtgactgggagaggtggcgccagggggatcctggtttcctgtgcccacacagccactcacgtactctgggcctctgggccgtggtggttcaagctcccaccatccccacttcttggggaaaggctgaacagtactggggtgggggtgggggagcagcaggcggggcctgttgagcaagagccttgtaaaaacaagggcttacgtcatcctagcttgcagcttccctgcaggacacctgggtcggcaccggggtgggacctgcgctgagaagggatgggtcatccccagcagggggtggagggtggggaagggtggcaagcatgttccaccccagaggccagagggcctagacccctgctggggctgagtctggtctttgggggctggcctgcaaggtccgagtaacaccttaacgcactgtgtgaccccaggtctacccttctctgtgcctcagttcttctatccagaagatgggactcacattgccaggcctgttatgacaaacccaagagggaaagtcagactggaaagattttattccttctcatcctttcatgtgacctggagcagacacacttagctcttctgggcctcagtttcctcatctataaagtggagataatgataagactgtggcctggcgcagcggctcacacctgtaatctcagcactttgggaggctgaggcaagagggccacttgaggccaggcgttcgagaaaagcctgagcaacagagtgagacatatccatctctacaaaacattgaaaaatatgaaaaaagaagaagaaaaaagacctgcctcctacaaattatcagtaggattaaatgagttaatacatgcaaagagcttggaatgtggttcagagaaggtggaagtttggcctaagaacacacagcaaatcctccaattagcttcagttcccccatatctccctgcatctcttcagaatccagaaagggaacgtgggcgagtgctttggttcagagaggggagccattttgcctaaggtcacacagcccagctaacgaggaacctctccttcttctcagcctcctccatttattcactcaccattcatcgagcaccttctatgtaccaggctctgttctaggcaccagggacacagtagtgaaggccgtggggacagacagcaagactggcaggcaagataattctgattataatgagaatggtgacggaaatgaagcaggggtgtgagaggagtgactgagggcctagacttcccatgggaaggtcagggagggtttcccggaggaggcagcttttgggctgagacctgaggagctgccttgggcagaggtggggtgacagtgttcttggtgcacagggaacagcaaatgcattccttcactggtaaatgttgagcgtgctgtgctcaggagtccctcgtgggccagccctccccaagtggcagcctgcagggagactgaggtagacagctaggataatggtggctggcgatagggaaggaaattcactagcaggtgggacagggagggcctctcagaagccgtggcctctagctcagccctgagtgtcccattttgcagtgaggaagggctggccgggtggccctagggaagctgccgcacccctctgggccttgatccctccccaacccagaggctgctgggaagacccagaaagccagcaggctgggccagtgttttatcccctccctccctgcctcctacccaccaagggtgcccagagatgtcatttctccagctcttgggggcggaggtcaccccagctcagcagataacaccaaaggttgagcaatgcccgcctgcccgctggggccagggctggggtcagtgggctggggatcagccccgggcaggctgggagctcctgcctaggtggcctgggctaggagtggcagagaggtgggcccagggagctgccccaatggcctaggaatgggtccgggagggcaaagggccctctaacctgagcctacccagcagaggcgggcaagtggtcagaaggccttgggcctgtgttcaagtccaggcgggccgttgtcgctttcccgtctgtgaaatggcagcagcaaaagcatcttcctggtggggtgaaaaaagttgaacctcggggtgcaggcccaccgtaagcacagggcagggacttggtaaaaacttatctttctctttccttctctttcctgcataccaccccctcccgtgaggcctcgcttaagtccctccctagcaacttcagaaacagaagtttttggcctctgggactggcaataggtcttagggctcagatgagggcatttcatttgggatgaatgggggacatgcggccatgtgaccttggtatgccacgccatgctctctctgggcctccactggcacaatccgtgggggtcccgttctctctgatgtgcagcccacaacgtaagccttaggtttgggagtctggtgggaacaatgccaccaccactgacagtagcgacacccttcatggattgcagctgggagaagtgaagtgactcacccaaggtcacacagtgtggcagggccgagcaccccccgcccctgccccatcccagggcccaggtcgggtggcgcagcgcggggcaagagaagacccgggcgtgtccaagcctcgagcaggcggcaggtgtggtgggcggggctaggggcggggctccgtggaccagggtccagccccaagcggggcgcgatcctgcccggtcgcgccgacccccggggtcctcatattgtctgtggcttaagaggggagtcgtcacaggcgtcaagtcttctttctaaagccggggacctggggaggaggtgggagtttacgggaggaagggccacggagatgggtcgcttctcctggagctagagctgcgggctggggtctccagggttcggcccggggagccgaccctggtcggccgtcggggctctgctcggccctcctgaaacctccgcctcctccagcagggggcgggccggggccgcgtctcggggggaaggcgatcaggtcgccccctcctccgattcccccgccttccaggacagcctccagcccagaggggcggtccgggggcggggtcgcaccgccccctctcgctcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagtaattggcttttgttttttatttttttactttattttggatttgtaggattttgtttttgcgtttctggtgtgtagggggttgtgtgtggggggctgctgttatttttggaggttttggtggttgggtgggggtgttgcagctggtttttctgcctcctctgctactccccctcccacacacacagggtctgcttgagatggggttccagccccgggggaaaggggagaagagtaatgggtcaggcattcaggctgactcagagcccctaggcgccgggacgggtggctgggaaccctgcttgagaagagattccggagcctctggctggtcccgagtgtcaggcttgggtttggaagggctgggaggtctgtgacccctgccctgtgtttggggactaggtaggcaggcctgtgactgtaggaggagggggttcaggtcttggtcctgctgagcccgagtcagggcagatgcttttggtcagtgtagtggggtgggttgtttaaaacacagtttgtgtatacatgtgtattttaaagaggggagcctgggtgtgtgggcgagtctgtgtttgtgtgtccctggccagcaggaggggagaggccaggccaggtggagagaggtgggggaggggttcccacactttgattacctttcctgaggatgggaggctcatcacttgctctctttgcccagacttggacactgagcccacctcacctgcctgctcaaggtggctgagcccaggcacaaacgtggggctgctagccctgattccctgggacaggctcctcttccctgcccactgatccctttgccccttccggcttctcaccgcaccccctactcccatccagccctggatggcattcctgagagttgaggatgtagatggatgtgagtggatacatgtacagcgtcccacagtgcctggcacgcaagaagtgttatataagcgcttgctcttgttattattttttgctgggaagctgctggcatttggcaccccagtctccagtgcagcgccagtgtggccagtacttgccaggggccggcatctggtaaacactggacctgccccatcccatttagacctcacaataacctttgggaaggtggggattgttatgacgcctgtttttagaggtggggagcagctttgggctgtccgatccctatgggcaagacactggttgggggttgccctgccctgaggaattcaggggcagcaggcatcgtagcctggtttgccaaggacctggggcggtctgggatctcaggagcagttgctgataccgtggttcgcgaatgggaaatgctttgcccctccttttccttttgggggcctggttgtgctttccctgtgggagcctgggatgtggggaacagacagcgacactcatcccccaccgccacaaagcggaggattcctataagctccacctccctaatgccagtgtctcctgatggtggctcgagggctatgcagattgctggacacagataacctcacttcaacctgggacctgcagcgtggccctgaccacgtcccctcccagccctgggcaactggacaactggccgggcatgccttcaaagcctcgaagtcagttcagtcccaagccccactggtctcgatggtttctgtcagtagcagcgacagcaatgtgggcttgacctcaaggatttacttgctgaaggcagaggctgaggggctggacctagggaaggagggaggtggagagggtcgaaattgaggaacaaatctcaaatccctgctccctcctttgtcaccaagagttggctggtggccactgctcacccaaatgaggtgagagggaagcagcctggccagacggtgcccctcttccgcccccgtctgccccacagcttcgcttctgtttccccagtgctgtcctggaaccagcgttgagtcagttcttcacacactcacatcttgctctcatccacagtaccccacagaaggtgctagacccatttctaaaagcacacattgaggtccacagaagtgaggtttgtgctcaaggtgggctaggtggagcaggttacaaaaccatccgactcccaagtctatggggaaagtttggggctgggagcctggtttgtaatcccagttcctgtttaaaatcccaggctcttcttggagggctccttgcctgacctcaagttcaggcactccaagccccagaactgcaaacatcagtttcacagtttggaagcaacagaaagtgaatttgaacctgaaccccttgggctgcctctaaggagggctgggagaagcagttcacaggttgagggctttgacggtggcttggtatgggagcactgtggacggagctgtgcccaaaggacttggggagatgtcatagttagggcaacaccaaccccacagttcaccaagctgcaagggtgaagggctcgcagggaggaaccagtccattccgacatccagaaacaggagggggtgggatggggtgaggcgagcccaggaggccagggacgagccttgaggaatcatgataatagcaggtgtgagacaagggcttagatgtgcaaagcaccactccaagcccttggcacagagggaggtgctgggtccttagatatgtgggagaaagccggtcatgttaaccacagacccatttagtgtgtttgaccactgaggctagctgggaggtgggagcctggaaccccaactaatgtttgctcaggacaagagagttcacaaaacaagacacattcacacctcataatcttatgcaattgtcccacggcctggtgattttagcaaggagataagtggatgtcagaaatgaacgctcgagacactgctgggtgccggttccacactgacactgtgctccttggtttaatcaactcattagccttttggaggctgcagcttttgttactagcattttgctgctgtgcaaaccagcttagagaggtgaactgacctgtcttaagtttgcacagctaagaatggcagaagctggagtgggagtgagaaggggaactgctccttctgaacacctgaagaatatttccctgcaggctgggcgaggtggctcacgcctgtaattccaacattttgggaggctgaggacggcagatcatttgaggtcaggagtttgagaccaaccccgggcaaaatggtctctactaaaaaaatacaaaaattagcctagtgtggcggtgggtgcctgtagtcccagctactcaggaggctgagacatgagtatcacttgaatcacagaggcggaggttgcagtgagccaaggtcgcaccactgcactccaacctgggcgacagagcgagcgtgcctctgtctcaaaaaaaaaaaaaaagaatattcccctgccttccaagttttgtccagacctctctgagactgttttctcccagtttctcagtcgtttttttgcccagttatatttttcatttatttgacaaacatttattgagcacccgctgtgtgctaggccccttactgggtgttggggacatgtggtggccaagatggaggtgataattttcagggagacacagatgctaagtatccagtgactggaacaagataatggcagatggagtcaagggctctgcaggaaggaaagtggggcagaggtgagtgggagcggtcctgcgaggcccctcctaggaagtggcatctgagcagagacccctgagcccagggagtcaggagtatggtgggctgcagtttactggatgctcactttgcacctgctggtgtcctgcatgccttattcttaaaatcccaatgatgtaggtgcttttttttttttttttttttttaaaggagtctcactctgtcacccaggctgtagtgcagtggcatgatcccggctcactgcaagatccgcctcctggattcaagcacttctcctgcttcagcttcccaagtagctggcattacaggcttgctccaccatgcccggctaatttttgtgtttttcataaagatggggtttcaccatgttggccaggctggtctcgaactcctgacctcaagtaatctgcccatctcagtctcccaaaatgctgggattacaggcctgagccactgcacccggccatgggtgctacttattactccccctccccagatggggaaaatgaggcacagaaaggtgaagtcaccggtccaagagctggtgagtggctgatgtgaggtttgaattctcaccttgcatttgaacctgagaggccttctctgcctgttttcccccatggccctgagcctctcctttgctgttttcctgtcctgcccttccaccccctcctgagttctttctcagcttggccaatctcctgcgtggcctgtgatggcgtcccagcagtccccgctccctgtgggatttttgatggtgcattggccggggcagggtagtgagggaggcctgggctgggcagacccaggagaggccagagtgggctggggaagccaggggctttctgggctggtggtgttagcccctcccaggtgtcttccgagacagaaaggaaagagttccattttacagagaggagacccgaggctctgagaggggacagttcctgtcccaagagcagcaaggttgggatttgaatccaggcctgcctgagccccaagctcagccacttttctgtctggttgactgctctggggaagagacacgggaagaacacaattagacacctctgaggggtaggatgcttgagcaaaagagctctgggccttgtcccttggttgcagagtgaccttggttgaggcacttagccttgctgaacctgggcttcctcacctgtgagcacggagtacagatatcacccagtgtcgagcaagcacccattgtgagcccaagatggtccctgacccccggagctgtcattgtggtagaggagacaatgtgtggctagcagattggcaagcccattgcagattgtgataaaggccctgaagaaaataaggtgggggaagtggaggagggtgattgggggggaacgcgtagggagccttccaggctgggggaacagcacacgcaagggccccgaggcagggcccagctccgtgtgaggagaagagcctggagccagcatggctggagcagaggcagcaaggggaggagtggggaagaagaggacaggggtggggcagggtgggggcacagggctcctcatgcaggggtggagtaggggaggggaggatgggggcacagggttcctcatgcaggggtggagcgggggaggggaggataggggcacagggttcctcatgcaggggtggaatgggggaggggaggatgggggcacagggttcctcatgcatgggtggagtgggggagggaaggatgggggggcacagggttcctcatgcaggggtggagtgggggagggaagaatatgggggcacagggctccgcatgcaggggtggagtgggggaggggaggatgggggcacagggttcctcatgcatgggtggaatgggggagggaaggatggggagggcacagtgttcctcatgcagggctggagtgggggaggggaggatggagaaagcggggaggggtaggccacatctttcatgcagggtgttggaggctgggcgggctgtgaggtggctttgaggatgagagagtgggtgtccctgccaggtgtggcacccagaaaggccttgacaagcctgtggagggaatgaaataggctcctgggccttcgggatgaggtaaagtgcagtcggtgaagggcacagggaggcctgcccgggcccaggagacctcgtaggcgaggagcctgtgacccagggcctggagccacggggagcagttcatcgggcaggaatgaggggagggctcaccaggaggggcgctggaggagccagggccgggagccaagagagggagagttctttgggtagccctgactgcaggggagagggcaccaacccttgtggggagagaggcaaggctggagagggaggggtcttcagggtgggattggtgagggactggggacaggcaggagacaggacctctgcgggggtgtttgctttttatttgatttcccaagtaatgcatgattgtgatgggaggatcagagactgcagagtataaataaaagaaggaaataaagagcactactcagaaataaacccattaacacttgctgtgtggccttgggcaagttacttcacctctctgtgcctccattttcttgtttattaagtggaataattaatagtacctgcctcataaggttgttgtgaagcttaagtgagataacacaacaaatttaaagcagtgccacacacagtaggtattagctgtcatcattattcatatcatcattaccattttggtgggttaggagcttagatgctagaattggaatgctggtgttctgaattcaacattttcttttttttttttcccccttgagacgaagtcttgctctgtcatccaggctggagtgcagttgcgtgatctcagctcaccgcaatatccgcctcctgggttcaagcaattctcctgcctcaacctcctaagtagctgggattacaggtgcccgccaccacacccggctaatttttgtatttttggtagagattgggtttcaccatgttgtccaggctggtctcgaactgacctcgtgatctgcccgcctcagcctcccaaagcgctgggattataggcgtgagccaccgcgcctggcccaaatccaccattttctagctctgtagtttgaggcaagtgaatgcatcttgctggacctcagttcccccatctgtaataagaagatcataaaattcctcacagtgttttgcaaagatttgacaggttaactcacacagggtaagttgttaacttccagaattttcattccatgtgtatttttcctcattgtggctaaagtggccgatccaatactcattcctctccctctttcttaccaatgagatccttctattttgggggggcaagtaccctactaagagactacagtttccagcttctcttgcagctagggatgaccagtgagattaaatagaagctgtaggtgggacttctgggaaagctctttaaagggggttgactcggctgtgaggcacattcccttttgtgttccttctctgccacctcccagcccctgcttctttctacttcctgcctggaactcagatgtgatggccagagctccaggggccatcctgaatcatgaggcaaactctgaagcatggaagccacatgctgaggatggtgaatccgaaagacaaaaggcactggggttcttgatggtggtagaacagccgcaccagtctttacctgctttgctctgggcttgtttacatgagagaaagaaatctctgcttactgaggtctctgtcgtttgggcttcctgttactggcagctgagtctatttctaactgatatatttgccagaacggaatcaacctgtgtgagctctttcacgacctgcattttttcatcatgcaccagtgcttccttgttacggacactattgcacatgagcacagaaatgcacgctttgcttaggaaaaagaatttccatcagatgtggtggaaggatttctttttattcattttaattacagaagtaatgcacaaagacctcctgtcatgaaaatatcctgcctgtcctcaagtgtctctctctcatgactctgaaatttcagtgtgcctcagcccaggcttgaaccaagcccttgaaatggacagaaatttctctgctgacctcagtgagctccgcattttgtagccctagcctgcatatgtgatccactaagggactcctccgtttggaaacagagatggtcaggtcctgctgcagctcacagagcctgttggcagctgcgctgggaccagatgccccatgccaccctgaataacccttctgacccatgctgcccgccaccacctgctccactgaggccttggcctgccagggctgggaggcacctttgccagccttcctggggccagcccagctgagatctctgggaggtgagtctggaggccagggagccgggccgggtgaacttttatttttatagctgtcatcagatccctgccctagccctggagccctggcagggacaggggtggccaaggaggaggaagactcctcagagaggctggtgggtgggagtcagcaggctgtggaggagagagaactggggtgggggtcagggcagcctggggcacctgactccagccaggcctcagtcctctcatgccacatggcaccagtcatcaagctcgcctggctgaccctcttgtggggtggtgagggacaaagggacaacagggaccctttcctgcttttattcttgcaggtcagatgcagagctaattatgctttccagttcttaggacacgattgtcatcagtccttgcaaagcctgcattgcgctttagtctattttcccgtgcatcacatttttttctctttctttcttagtgaaatatacacacacagcaatgtgcacataacacagatatacagctctgtgaattttcctggtgttgacccaccagtgtccagatcaagaagagatcattccagcacccctgaagccttttgtgtcccttctagccacccctcttccacacctaagggtaatcattattctgatttctaacagcaaacattaattttgcctgtttctatgcttttatagaaatgaaatcacacaatagatgctgtttatgtctggcttcttttattaagtattgtaactaacattcattcaagttgttgtgtgtatcagtatttatgcctttttattactgagcaaaatgacattacatggacacaccacaatggatttacccattcgatccctcatggacattcaggttgttaccagttttgagctctttagaattgggctgagatgaatatttgagggatcatgtcttttttttttttttttttttttcttgagacagacttgtgctgtctcccaggctggagtgcagtggtgcaatattggctcactgcagcctctgtctcccaggttcaagtgattctcgtgctcagcctcccgagtagctgggattacaggtgcccaccaccacacctggctaattttttgtaattttagtagagatgggcttccaccatgtttgccaggctggtctcgaactcctgacttcaggtgatccactcgccttggcctttcaaactgctgggattacaggcgtgagccaccgcacccagcgaggggacatgtcttttgatgaacatattcacatatttcacttagaagtggcttgctaagccatcagaaatctaaaaatatatgttttaattcctgttaatggtattgaaacttagctctcattctgttttttacttttttactgtgtatttttaaaaaactttttagtttgagaaacgtctcaaattggttctcttgaattatttgagaataaattgctgacctgttgccctatcaccccttaatgttttgatacatagtttctacaaaccagggcattttcctagatagctacaatataaccatcataatcaggaaattaacaggatacaccatgactgtctaccaagacccattcaggtttcaccagttgccctgataacatccagtaagggaatccagtttgggatcatactttgtgtttatttttaattttattttattttgagacagggtctcactctgtcacccaggctggagtacagtggtgtgatcatagctcactgcagccccaactacctgggctcaagcgatcctcccacttcagcctcctgagtagctagaactacaggcatgtgccaccctgcctggcaaatttttgtattttttgtagacacagggtttcactatgttgcccaggctggtctggaactcctgggctcaagcaattctcccaccctggcctcccagagtgttgggattacaggcatgagccaccgcgcccggccacatgttttgtttagttccacatctctctagttgccttgaaggtagaacagttccttagtctttccttgaccttcatgaccttgacacttttgaggatacagggcagctgttgtacagcattacagcatgtctttccctgtgggtttgtctgatgcttcattgtggtgagattcaggttctgcagctctggcagaaaaatcaaagaagcgatgttatgttcttctcctcgtcccattgctgatggtgcactctttgatgacttgattgaggagatagctgccagacttcgcatctgtagggttactttccccgctctttgtagttaatcagcatttgagaggaggcacgctgaaactgtgtgaatttcttgaatgtcatcagactttcaattattcatttatttctgtcagtatagattcatagttttctattttattcagtgggttgtggtatatcatcatcattgttaacttatttatatgcttaaattgtcccagatttggctcctgggagccacttttaactagcttctgtgtcaccatcattctttgagcattttcttactttctggcacagtgaggtactataagctcatctggtattttttctgcccccagctctggaatcagccacttctcccaggagccctggttccttttagtagagaatggaatttagaagccaaaatctcaggacaaagtgctcattgctgttggggtgtctccactgcctgactctctcagtggacagagttaaggactgtatatatgtatatatagagacacatatttacagctgtgttatttctgtatctaactattatctgtctatcatctatcatctatttagaaaaatgagtgtacactgataactgcagttcccattcagcatcacagagtttattctaattttctctttccatatttgaaactctcttttccatcagtgagaaaataggcttccattattcttaatatatttgtttatttgacccatcccctatatgtaaccagtttgctgtcactgtccccccacctctgttccatgattggtcaccctccttaccctgttcagtctctggccccacactatgccacccttcttatggatggcctcagatcaacttcaccatggcctctatacatttttcctttcaatttgaatacataatatgtgctcattgttcaaaattcaaaaggtgtgaatggatttgcaatgaaaagtctgtctccctcccactcctgcccccacattcccagatccctctcccagaggttactgaagtttccagcagctttttcttatttcaaatggtctatgtgagtgcacccaaacacacacacacacacacacgatatttatgcacactgtagcacattttttacactgacctgtgctttgcttttctcactcaacaatgtatcttggagcttgttcatatcagtactatagagctgccacattccttttaatggttgtataatattccattggatggatgtaccataattatttaaccagtctctttctgatggacatttagattgtttccagtctttttctatttcacacaatgctgcaacagacaattctatccaataggtcacattttacatgagtgcagcatatattcctggaagaataggcttgagagatgcctccaggttgctctgtgtccctctgattcattactttttatgctgatgcataacattcctctgtatgtatctgccacattttaaggaaccactgcccttgtggtggacaatgattttgcctctaagtccccacagccataaacactgttctgacaagcattgttgaatgtacctctgtcacagggcaggttgtgtggatactgaaatggagtttggagtgcaagatgtttgtgggggtcaacacctgagaaatggagggggtgcaagaaggactgggcagatgaagtcatccagcagcgatgcaggcctgcagagccctgagcagtcttgggagcaccggagaggaacttgcttgttgggtgccctgtgttgggcaaaatggccagacctttacaccctgccttggtctgtctggctttcgggctgccctgggaaggatggctggggcgagatggctctctgcagctgggacagctgttggtggctggagttcatcacctcatcatactccctgcagctggttctcccctgaaggagacctaggtggtacatctttgtgtttatcagccccctaatggtcttctcagagtgcctctggtgtatttacccaggagcgggattgcagagtcttaatgtcactaatagggccagatatccctggtctcagccaccccacaaggatcagagatctgcatttttgaggtagtgagattgtgatcatggaatgaactgaggctgactctctaaggccccctgccctatgccgggccgttcctcctcatcgtccctcgttccttcgtgatctccctatagggctcatgagttggatggatgtgagtctaaatctcagctttgtcacttagatgtttgacctggagttagtgacctcttcttcctgagcctcagtttcctcatctatgcaataggtcttgtcacatccttgacttttgtgcattgtgggtcttggtgaaaagtaagccctcagtacatgacagaccatatatcaggaacacagcatcacttctgctgtatccctgcaaatatatatcagacacggagaccgaatctaatcacgggaaacatccgagagatctgaagtgaggagcactttgggaggccaaggtgggtggatcacaaggataagagatagagacctggccaacatggtgaaaccatctctactaaaaatacaaaaattagccaggcatggtggcctgcacctatagtcccagctacttgggaggctgaggcaggagaattgcttgaacccgggaggcggaggttgcagtgagctgagcctagattgcaccacagcactccagcctggcaacagagcgagattccgtctcaaaaaaaaaaaaaaaaaaaaaaatagctggcctgcatcctcgaacatgtcaaggtcatgtgggtcaaggagagactgagaaaggaactgtttcaggccaaaagagcctatatacaactaaaggaagctacatgcgtgcgatcttgggacatgatagggtccccatcacattagggccccaggtctttgtgtttctaaggctggagctcgagctacctcaggctcaggatgggggacacttccccttaagcaatgagaaggagagaggctgacttggagagaacagggagtcagggagcttgggctggattgttattccccaagaagagttgcaactggactttcgcttcagtaatgtttaaaagaaaaatgctaatctagatagggactgccattcattcattcattcattcatttatattcctcttaacaacttgtgactttgggcatgtggcttaacttctcggttcctcagtttcctgtttacaaaataatgatggtaataatagtacctatctcacaagatgtggagaggattaatggagatgataggtgcaaagtgcttagaatactgcctggcatatagtaaatgctcaataaatatcaattatcatcacaaggaatttactccacaattcatttactgagaatgtgcaacatgccagagttagttgtcactctccacctggaactagaaccacggaaaaccttagatcccataaaaccagagcctagcaaagatgacaggatcttagtgtgtcactaccctgcccatcagtctggctgccaatgatggtttaagatcccacgccccctacaatttgagcccaaggcctcctcctgacagccatgtgaatgccccacgcctcagttccccagatgttgtgacagcctcaaacactctccaacggcactgatttgaacccttgtaaacgcagaaaaaaacaagtcttaggcggcaaaaccccatttgtgcaatgtggactcccttcctcaagtcctgggtgatgctgaagggtctgaatctgccttttctttcccgcctgttgggccctggtagaaagtagcagctgggccagggttggtggctcacgcctgtaatcccagcactttgagaggccaaggcaggtggatcactggaggtcaggagtttgagaccagactggccaacatggcaaaaccccgtctctactaaaaatacaaaaattagctgggtgtggaggcacgcacctgtaatcccagctacttgggaggctgaggcaggagaatgggttgaacccaggaggcggaggtcgcatgagccgagatcacgccactgcactccagcctgggtgacagagcaagactctgtcccaaaaaaagaaaagaaacttcaggatatccttcagctatattgtttatatttttccccactttgtcttttcccccatttgtatttttttcttttgcctgaattatttgagaggcagctgtagacatgacatcactttatccccaaaccctccaggcatgagccaccatgcccagcccatgcacactatagattaatgttaaaagcattatgctgagggaaagaagccagacacaaaagacgactttctgtgtgattcctctgatatgaagttcaagaacaggtaagatgaatctagaaggcacaaaagtggttccttctgtggggtagaggagtcattgcctgcagtgggacatgaggaagacttctgggatctgcaaaattcctatgttttaccccaggtggtagttccatgaatttatccatatataagaattcaggccaggcatagtggctcacacctgtaaccccagcactttgggaggccgaggtgggaggatcacttgagcccaggagttccagaccagcctgggcaatgtagggagacacagtctctacaaaaaataaataatattagctagatatggtggtatacacctgtagtcccagttactcaggaggctgaggtgggaggatcgcttgaacccaggaagtcaaggctgtagtgagccatggttgtggcactgcactccagcctgagtgacagagcaagaccctgtctcaacaacaacaacaacaacaacaacaacaaagaagagttcattgagctgtctgtttatgcgctttactgtacatatgttaaacgccagcatcaaagtagaaacctaaaatcaatgaactcatgctgcacattgaacataggagagtcaggtgggcagggagtagggattggggtgaaagggaataaatgaatacaactagagggcagcctgtgtgggcaatcatgataacatgttgcgaattgaggcatcagataacgtcaccctgcacacctgaggttcaaaaagaaaagccaaaaaagacccaggagctcagagggggagtgtaccttgtctgaggtcacacagctggtgggtggcagaggcaggatttgaacctgggtctgaggaaccccagagtgtgctccttacccagtgctctggcctggactctccgggctggacagctctgctgtgctcccagaggtccctagggtctggcaggggatggcgaaatgactgcttggcaaagaccattgcagctcagagctcacagctccaagtcgggaggggagtcagtggagcaaagggtggctcccatccctggagccttccctccctggcctagggtggctctgccaccctccgtccacctcccgccggcctttgccttccttcctgggccagcgtgtggactctggagccctgcagggttgggtgtgaatcccagttcttcttctttctggctctgcaacctggggtgagtggcctactttgtacctccgtttccactttcagagcctgcctatgacagcatttacttaatagcattggtgagcagagtcgaggagtcaaaagtgtgcagaactcaacaccatgccggcatgtgctaattgtccaataatggcagctgctattgctgttgttgatgttattgctccttgggagaggggagcccctgttgctctaaggccttacaaacaccaacatgtgaaaacagctggcatggaatggaaagttctagagaaaggagctttctgactgcctgaaggttatcagaaaactttctatgctggtttttgtgaaagctcttggtaagctagggtagaaccagggtggcttcatgggagtaccatctaggcaattccacagagccccttgtttggaagggcccccacttggtttacaggtctgctgttgtcatcttgaaattctctctctcttcttttttttagatagagtcttgctctgttgtccaggctggagtgcagtggtgtgatcatgactcactgcagcctcaacctcccaagctcaagtgatcctcccgcctcagcctcctgattatctgggattacatgcacatgccaccatgcccgggtaatttttatttatttttatttttattttttgagacagagtctcactctgttgcccgggctggagtgcagtggcgccatctctgctcactgcaacctctgcctcctgggctcaagcgattctcttgcctcctgaatagctgggatttcagacacccatcaccacgcctggctaattttatacatatatatatatatatatatatatatatatatatatatatatatattttttttttttttttttttttgtttttttttgagacagagtctcactctgtcaccaggctggagtgcagtggcaagatctcggctcactgcaaactccacctcccaggttctaagtgattctcctgcctcagcctcctgagtagctgggactacaggtgagtgccaccatgcccagctaatttttgtatttttagtagagacagggtttcaccgtattggccaggatggtcttgatctcttgaccttatgatccacccgccttgtcctcccaaagtgctgggattacaggcgtgagccaccatgcctggccaatttttatatctttagtatagatggggtttcaccatgttggccaggctgcgtcttgaactcctgacgtcaaataatctgcccacctcggcctcccagagtgttgggttacaggcatgagccactgtgcgcagcaatttttatttttatttatttatttattttgagacggagttttgttcttgcccaggctggagtgcaatggcacggtcttggctcactgcaacctccgcctcctgggttcaagtgattctcctgtcttagcctcccaagtagctgggattacaggcgcctgccaccacgcctggctaattttttatacttttagtagagacggggtttcaccatgttggccaggctgacctcgaactcctgacctcaggcagtccgcccgcctcagcttcccaaagctcaggggttggaggcatgagccactgcccccagccctggtaatttttaaaattttattttttgtagatattggagtagggaggagtctctctatgttgctctggttggtcttaaactcttgggctcaaacaaccctcctgccttactctcccacagtgttggtattacaagcatgagctgccgcacctggccttgaaattcttaatgatttgtgaacgagggccctgcatcttgatgtggccagtcctggctgtactgtggcatccggcatggtcacctagtactttcacctgagttgtctcctgagtgctcaggaacactctttgagggcagttgtcctcatcgttaacctcactgacctcagtttccttacctgggaaacgggaggaagtgcattgtgccaggccacagagaaacaatgggtgaaccttggtcttctggccctcagattctatcagtgggaaacttgggcaagtaagggctaggcatgcctacgtgtgtgcccctggagcacagaggaggttctcagtagctacaacttgctctttgattccctggctggcctctctttttgccctaaattttttttattaaaaaaattttttaagacacaaggagacagggcattagaggaaagagctaatacatccaacccaggtgatgggttgatgggtgcagcaaaccaccatggcacatgtttacctatgtaacaaacctgcacatcctgctcatgtaccccggaacttaataaataaataaataaataaataaagagactgagtcttgctatgttgcccaggctggagtacagtggcacaatcatagctctttgcagcctcaaacccctgggctcaagtgatcctcctgcttgatcccaaagtgctgggattataggcgtgaaccaccgtggctggctgtctttttgcctttttactaagaaattttgatttaaattgataatagtaatacaggtatccattctcttaacacatgataacatttccaatcaagctgaagtcagttctggaccatctggccagggctggctccttttcactctgtcagcgtggttttataattttggggtttgaacttccagatctttgtgtatgcatttctttcatctctgtgtgaatgtggcttttccttccttcctttctttctgttatatcttttaaaatgtgaacttttacagaagtctaagcagggtacagaagatacatttttaccacctgaacacaccagtgtgagcagcacttggataaaaaagcagaactttttttttttttttgagacagggtctcactctgtcactgtagactggagtgcagtggcgagatctcggctcaccacaacctctgtctcgcaggctcaagcgattctcctgcctcagccccctgagtagctgggattacaggtgtgcaccactactgcccggctaatttttgtatttttagtagagacagggtttcaccatgttggccaggctggtcttgaactcctaacttcagatgatccacctgccttggcctcccaaagtgctggtattacaggtgtgaactaccacacctggcctgaaacagaacaaacatttttaatcactgaaaaatgtttctgtctaggacaactgctctcctgacttctaacagattacattgttttgcctgttctacaacttcatatcaatggaatcattcagagtatttgcttttgtgtctggcttcttttgctcagttaaacttttaaagttcctctatgcagtactgtacagcttcattctcactactgtgttgtgttccactgtccactgtgtgactataccatagtccagtctactgttggtagacagttgggttatttcaaggttttggttgttgtgaataaagctgccatggacattcttctttgtgtcttttttctttttcttttttttattttattttacgagttgggatcctgctttgttgccaaggctggagtgcattggtgctatcacagctcactgcagccttgaactcctgggctcaagtgatcctctcatctcagcctcccgagtagctgggatcatggctatgagccactgcacccagctcttgtttgtgtcatttggtggatgccagctcttgtttctatcaagtttatacccgaggcatcatcactggacacatcattcacgtgtgttgagtttctgcatatttccaaacagtttccaaagcatttcgctactgctgtcctccatatttctggcccatctcgctccttttttttttttttttttttttttcagatggagtcttactctgttgctcaggctggagtgaggtggcaccatctcagctcactgcaacctccgcctcctgggttcaagcgattctcctgcctcagccttctgagtacctgggactacaggtgtgtgtcaccacacccggctaatttttttgttgttgtatttttagaagagatggggttttgccaggtatccgggctggtctcgaactcctgacttcaagtgatctgcctgcctcagcctcccaaagtgctgggattacaggcgtaagccaccatgcctggccccatcccttgattctgagtacacctggagaggtcagtctttttaatatgagctatttggccatgtgtgtagtaatatctcattgtggtttcatttgcatttccggatgatcgttctttttaatgccttggcgacctcacaccagccatctcaatgggacttgttcctgtccttccgtgatgttcttgagagccgtccacatggtgcgtttgccagtttcctcctttggaaggtggcaaggtcttcccacttgataaggacgtctcctgtgactttgcctctgccccatatttctagtccatctctttccttgactctgagacctttctgtaagcggggactccatgatgttcacacacttggtgcccggtaaataaacagctagtaaatggactgacggaagcaaaggggaagaaaaacaaaaaaaaccctcctcccccaaaccccaatttggttaattgaggggttccactggggtgatttttggtcaattggagtttgcttgtgaaaccggtaagagcatggacaatcaaccataaggtagcaacacgcactgagcccagcactttccagagaattatcacactgtggatgtcacaaggatgttgggagggtctagctggccggtgggatcagctacccctcaggcctccgatattttcctgaggttccacaaccgggaagtggctgggtaaggttcctagacccagggcctctgatcctacttgccacgatgtttccatcttgttctgtgctgtgtctgcaactcacagcctggcacacaaaagactctcaaagatgtgctccaggaatgactttgatgagcacacaccacacaccaggtgctgtgctaagcccggggatacagaagagaataaggcggccccaagccccaccttcatggcgggtccattattggggtgggggatacaggtggtccgatgatgagtgctagggaggaaaataaagaaggggagggagaggagagtgtgtgtgtgtttgtgtgtgtgcatgcaagagggagagaatcagagagagagtgcgtgagtgtgaggaagagaaggatgtttcacttaaccacagaggtcagggaatgcctggctgagggaaggtgctattgggtggggtggggcgggggagccatgaggtctctggggaaagagggaatggcatggcaagtgcaaaggctctgagatgggaccatgctgtctatgttcaagggaccgcaaggaggccagtaggggaggtgccattgtgagtgatggggagagaagtaggatgggagctgggaggtggtgtgtgtgtgtggcaggggtgggtggggttctgagcagggcggggatatgcctgacttcttcctcctagggttacagggtgggtgatgtcggccaaggggaggagagaacaaaatgaagcagttggtggaaagtatgcagcctgtggtctggtacacagtaagcactcaataagtagcagagtatgtgtgggttttggatgagtgaccgctaagctttttttttgacacagggccttgctatgtcacttaggctggagtgcagaggcacaatcatagcacattgaagcctctacctcctgggctcaagtgatcgatcctcctgccttgaccttccgaagtgctgggattacagatatgagccaccacacctggctggagtgacctgctaagttttaatgggattcctggtgggttgggtgatacctgaggggacctgcctacttgggactcgccccatggagggctcagtgacctcagatgagctggaggtggggaggtggtgggcaggcgaatgggaggaggaactggttgggggcaggcacacagtgtcccgactgggagggcaggcctttccgggctccccaccagctcccctcaatctctgtgtgtggtccacaggcaggacccccatttgggctctgtttatgtgtgattacaatctgtggtctgtctctcccataggtgctaagttccctggacaggaacccatctgttgtatgggtggctgtgtcctcagctcttagaatggcactgggcacatagcaggtgctcagtgactactggatggagggtgaagggtgggtgattttgtctacgagcagagagatgggtagacggatggatggttggatggctgggtggtgatgtgagcagcactgagatggaggagagatggatgggtgggtaggtgggtgggtggaaaattgggtgggtggatagataaatggaccagtagctgacaggagcctggaccagggtggggtagaattcagtagaaaacttctggcccaagagttagaagatgggggttcgagtccagtcttgctactgagtaataacaaggtctgtggaaacctggacttgttctattgttgctctttgcctctgcttccccattattggtttttcaacttcattattccttttattgtattggatagatccccttttattcaatccctggatgtttctgaagcctcactgcaagaacagagtgaaagggagctgcagaggagatggggggcagggcccagccctgggcagcccccgggagtcctgcaagccaggggcacagcttgaacacttagcctgactgttcaccattttgccacagcttcctcctctgagtctttcctctccagggttcctccagtgaagcctctgcttccagtggtttggagcagtcccagaaatctgcactgttaacaagcctgcctcatcgttctgaacttatttctggttaagattcaccgacaccttctaggactgctggatcctatagttcagcagcaccatgtgagtgcgtgtgtgcatgtgtgtgagcacgtttgcatgcatgtaggggacatggggtgggtggatggttgcaaggacactttctgtgtttaatgtgagattttatgtattaaaacaagactggaaacaactgcagtgttcatgagtggggccggttaagtgccatgaggccagtccgctccactccttgggggatcctgcaggcattacaaataagggaaaaggttctgataagacacgatctccaagacatccttacatgaaacagcaggtgcaaacggtgcctattgtttcaccacttgtgttaaaacatacatgcaagaagagaagtgtgggtattcgtggacaattctggaagaacacacaagaatctgagaccagggtggtccctggggagggaaactggggggctgggggtgggagggagaatgatggcattttctgaatccctgccggagtcctaggttcaaattctgcctgtgatcagcagcgtggctacccctaagccggtggtgagcactctttgagcctggtttccccgtgtgtaaatggggctgtgtttgcagtgtggggctgggctggcgtgcagggcccagacactctgctcctgttttggcttctgtttcccaggaggctcctggtcaggcctcaccttctagcagccccacttggcccagggagggtgggtccccggggagggggtggcccggtccagggtggggctgagctggaaaaaccggcaggttgggagcagtctgtgcaggcaccatcttcactccccagcctggaggctgtggggacactcactcccaccccacgcccctgggaggctgggaccagagagagagagagagagaaagagaaagagacaggtaacgagggcgatacagagaaagggagagacaagaaaggaaagagacagagggagacattcagaagcagagattcaggctgagagagacaaagattcagagtcaggaggaagggggcagtggagctcgggtgggggtgggggcaaggttgcctctggccaggtgcctgggactggacgaggcatgggggcactggggggtggggtggggatgtccatgcacccactgaccatgggacaggggtgcagggagctggagcccccccatcaggacatctcccacacctctgagctccagctgcaggtctgagtgctcctgggaatcctccggggcctctcacttcttgcccctccaggcctccctggggatgtgaacctggcagctgcctctccagggggccctcccagagcagagctgggagggtctaaagtgcagtcgagctaattagtgttaggcaccgagataatcgcagcttggaatgttccttaggaggtcctggttggggcaggcagcctgggggccatgagggtgcctgggattggcccagtaggtctgctggctcctagaaccctgagtattggagtgggagatttaggaagcctggatctttgggtcttagggcttgcagtctctcagtcctctccaggccatcctgtgtagcagccaaagtgacccactggactccattctgaccatgtccaccccagcccctgcctgaagccttcagtggctccccatggcccttaaactgaaatccacctgcctctcctcagcctaggggaggctggtgatgagctcttgatcctgcctcatcactctgacttatttctatttctggaacattccatacttggcccacctcagaacctttgcatatgctgtgtcccccagcatgccccctcatccaagagctctcaggcctcagctatacatcacctcactggggaggcccctgattcctggcttgcctggtctccctggatgcaccacgtagctcccaccccctgcttcccagggctcagcgctctctgttctcatagtggcattcctcattcaatgtctgcttcctccacccatggagtggcagctccatgagggcagactccgggtctgcttagtcaccgtggtgtcccctaggacctgacatgcagcaggtactccaccagtgagctactgaccaccaaggaagtggactggacatttcttgcagtgtggactccttctacgttatgaagggaccctactgagccctgggcttcccctgtgcccctcccactgccccagccccagccccagccccataagctcctgcgtcttgagactccaccaggtggccctggctgtgatgtcgcaaggaatcactggccagaatctggttgagattatctcctggctgggcatggcccacgtctccacgcagggctgggaccacaggccgccgcctcagggtccctaagtgtcccactgtgcctcttgtcttcagctgcagataacagcattggtccaaggtggccttgcctcagctgcaagtgcccgtgctagggacgcgctaggtggcctcagggaagtccttgtctctctctgggtctccaggtcacacagagtagggtcccaccccacatgggaaagcaaaaaactgggtagaaatggggtctctggttgggagaccttggaggaaaaataacagtgcttctcaagggggggtgaagtgagaaagtggttggtgacacatgaggggatccccacgtgtccccagctggggggcacagacagtccagggtgactgacctgccccaagttccctgaatgcctgaggtttaccagtgtcctggggcccaatgaggcaggtgtggaagtgtcctcgtagcatggtggaaagagttggcaagtgaggccttgagccgtttctagggcactgatcccatggtgcctcagtttccttcttgtgaagcaggtacaataagagtttctacttcacggggatactgtcctgagctcacagaaggcaattgatcactgccactattattgcctcctaaagtcttgtctcaccctgtctccacctctctgtgcctcctgccccacctggcctgggtgattaacccgagtgagtgcagcagcctccgactgctctcctgctcttagtctcagccctacatctattctccacatgctgccagacagagtctaagaaacacgggctggctgagcgcagtggctcatgcctgtaatcccaacacttcgggaggctgaggcaggcagatcacctgaggccaggagttcgagaccagcctggccaagatggtgaaaccccatctctattaaaactacaagaattagatgggtgtgatggcacacgcctgtaatcccagctacttgggaggctgaggcatgagaattgcttgaacccaggaggcagaggttgcagtgagccgagattgtgccactgcactccagcctgggggacagagcgagaacttatctaaacaaacaaacaaacaaaaaaacatgagctgggtcacgctcctcccctgctccacagcctccagggctcctactgccttcagaataaagattggcctccttatccagacccacaggtgctgcacagtggcggccccctcccctgatctctggccactctcactgtcacttgccctgctagagccaccttggttttctttccattgcacccagctcccacctgccacagggccttggcacactttgctttctctactggaacactttcgtttctcctcttcacctagttaatgccagatctcagatcaggtggacctctggtagcaggtgctgtggggattccccagagcctctttggtgggatctgcatgcatcttcctgctgccacacagtgttggctgctgtgggctcccagctggggccccttaaagctggagtcctgcctcgctgagcaggagctgcctcccatcccccaaacagaggtggacacagccagtgaccaatgagaccaggactcaggcctcttactttgaggtgggaggagtgtggtggtgcaattcacgttccagagctccccgggggatcaggccaagtgagactcagcggaggccatatcctggcttagctcccaccttgccctgtcctgcttctcgcacccttctcccaaaagcatgtcctcagtgaatcacgtgcatgccagtccccaagtcaggctcctcttctgggcaacctgacctaagatgccttccctgccctccctgtccccctttctggtctcttctccatggatctctccttgcagccctgactatggctgtgtttttacacttgcttggatgattatttgattgaaatctgtcccccaccccagaatgtaaggcagggatcatgttccttctgtgttcccagcgcccatcgtgggcttggcacatagtaggtgctcaatccatatttgttgaatgactgaatgaatcatagctgggtgagtcagagctgggcactatcaaggccccagtttcttcctatctcatggttctgccgtctccactcagcccagctcctcatggtgccacgatggctgccaaagctcctgccatctcttcctcatacagccaagcaggaaaggccctcacatgtcctgttaagaatgaagaaaccattcccagaagccccttggcagacttccccatctcactggccacagatgcattccatgtccagcctctgccaattgctgcaagtggggaaggggacctaatcagcatctgtgcctcgaatgtcgtgggtggagtccacccacacccactgagcggggatctggctgcctacgagcgcagacccctgaacttgggtcattttgactattcctagggctgtgggtcccccacctgtccttcctccctggggagcccttgggtggtggaggtgagaagggggcggtgctgggtgagggtttcaagcaaatgaggcggccagacaccttcacctcagtaaacatttacagagccaggaatgcagaggaggtggtgagcccagcagatgagtgtgtggggaagacaccacctaggccagaggtacagatagtgagacagggagacatgggggtgagatggagagacacagagagacaccctgaaagaactgatgtgagagacacagagggaaagagagaggctgagaaataaagaggggagagacccagagacagaggctttgccgggcaagcttttgcatcaggcctggagcaggcagaggccctcttccagtgggcgtggtgaccgcacctcgttctctttggctgaaagtcccaggcaagccccttttccagactgggccttggatcctcctgtgtcaaatggagctgtgtccacacactgggcctaacatggacctgtggcctcctgtgacccagaaacagccttgtgtggtggaagggaattgtcacccccagtggaagggggaggcagtgcccaggggcatggcgagagggtggaagggggatctggaccacggagtgcatgtttctaaagcctgtgtcctgtctgtgccccacagggccagtgtggggccaggaggggtgagggtggggcatgggggtacccttaggggtggtgctggccgccagctctgtgtgccagtgacgagtgttctggtcataagaatggctgctgggtttgaatgctccccaggtgccaggcaccaaccccaccagggtggtgctgcttaatttctatttagtttggacttcccatttacaaacgaggaaactacatctcagcgtggcagcgacttcctaacaacggggtgtaggctttggggtcggaaaggtctgggtccgagtccccgctccatccctgacaggctgggggacctaggcagtcatttcctcctcctaagcatcagtttccccatttgtaaagtggggaaataagtttaagggtgacatggggatcggatgaggtgctgccagagggttcttagcacagggccgggtacacaggaagcactggatgaacgttaaccgggccattggatacaagcttttaagtaatttaaaataattcctttaatggctctccttattttttttattttttttttaagggaaagagctgaggtccagggaggggaagggacttgcccaaagtcattggccaggtggagggtctgaggtttgaaccctgtgggccctgaggccctctataccacccacgatggctcaggcctggatggcctgtttgcgactcaatcctcatgggttgagaagatgcccatagcctggcctgatagccctctggcctgacatcagctacaaccaccagttggggcagttgcaaaatccctcaccctttgcctgtcgataaagggtgcccattgcaaaactcagcggagaaattattaagggttgtgtcatcctgtggccaggccctgggtgcctctttcctgcccggaagcctgggtagggccgactgctcactctctccctccatggccctgacccgagagagaatggggtgggggtcagcagggagcttgcagggaatgcggacgacagaccccagcactggggccgtcatagtccctgattcttaggaaatggcagctccatccttctgggtgctcaggcccaaacctcgggttgtcccttcatttcctctcttgccctgcattcgataactggccaggaaatcctgtcagcgccacctttaaaacatccagaacctgcgtaggttttcccctccgcttccacagctgaattcaaggccaccattctctctcctgcagtagcctccttgctgctttcactgctgtcatcgtcacgccccacttcccccgtgcagccaaagggatgctgttagaaccccactcagatcccatctttcctctgtttagaaccttccttggctccagctgcagagcaaaacctgaggtctttcccaggatcacagggccctgtctgatctggcccccatggcctttctgacctcatcctccctcctttcttacttgctcactcactccagccacaccgggccccttgctattcctccaacacactgggcatgacctaactagggcctttgcacttgctgttcctgctgcctggaatgcagttccttcagctctttcccccagctggatgtgccactttattcagatctcatcgcaatgtcacctcctcagggaagccttccccggctacctgctgaactgtcacctccaccatcactccagccctttcatctttcttccctacttgccatcatgttatacatctgttatttgtttggtcaatgcctgtctatctctttagtatgtcaccttccacactgcagggactgctgtctgtggtgatcacgatgctttctgagcactcagcacagggccccgcacacagtaggggctccacagagatttgttcaatcagtgaatgggcgcgcaggaggggtggctgttggcccagatgatgcttcagcaaacatcacaagtgtcctttctctggctgatggctcgaggctggtgcccagaacaggctgctgtggagacggcttccctgaccaccctgtcaagtagctccgactgcccaacccacacccatgctctccagtcccctcgccccacacttcccacagtctcaacttgttttgcttctgtatttttcatgggcccctcctcccccgagaatggagctctctgagaacagggtgtcctctgttggccccactgtcatccccctgagtgtccagtgcaggacccggcaccccatgggaagtgtttcatggcaggttgatcagggtttgcatcggatgccccatctgccgggctagttctggctgggagggtgttaggaggagatgctgtgctcggacctgcgaagtcacgggggagatggggacccacttgggccttaattataacacatcccataatgatatggtgttataatacgcacacaaagtgtcctaatctgatattatatctgggttttgtacaatagatacaatcggctggctgcagtttgctaattcattctcgacctatctccacgctccacctagatgactatcggcttccttaattaagtggaaggcaagctctgcaggcgatgcttgcagtcccagcaccgacgagtccggcctggccctcccataagctgggataatagctactcccacatggggcgaggctggttctgccttcttcatcccaacctcctgtcccagtcttgggcgtgacaggcctgctccaaggcctggtaagccacaaacgccaaccaccaagggctcaaaccggcggcctgtgggccgggccggcctcgagatgtgttgggtttggcctgcatggtgcttttgctgcaagttaaaatgagttgccaactatgaaaaatcagaatgtcgtacacaaacatccagattcccggcttctcttgggaaatgggaagatgcagggactcgggttcatagtcctgggtgctggggctggggagtggctgtcccctctagacaggacatgaccacagttgtctcctgccagtttcacttttatgtccctgcccgatcttgtaggcagttgagtttgcaatccctgctctgggctttaacaatcagttaccccttggcaagatgggacagtgaggctcagaagaggcaagtgacaatggtcattgcacagcgagctggaactcaggtcacaatcattcaacaggtctttattgagctcccactgtgtactaagccctggagacaaagaccacaacagatatagttcttgccttctggggggtgacagtctgttgttccacaggcataccatccacccttattgctggaggcaataggatctgttagagacaggtcctttatgatccctcagagtaggtggaagcagattccccatagcttctgggccccatccaggccagagaatggactctgaaaggtgcaaggggagtggaagcagccatcttggaaggaagctcttggcaagtgttcttactagagggggatgtccctaatctcctacctgggctcccagagagcaggaaggatgagcaaggtgggctcagaggggtcgcaggtgggggtggtgggggacaggaggggaacagagaaggcacagtggcatcagctagacagagcatggggactttcccatcctggttgaaccaagggtgaatcaattaggtccttctaagacaagaagtggagggcaagatgctgaaatacccaagctgcccacctactagtccaggagaaagggctttgctcagccagtctgggaggaagtgtttgtcctcttgcctcccactccactgcaccacccctggcccggaggagaaagtgcagcctggaacctctgtccccagtgcctcaatgctggacccagcttgggccattgcagaccagctggccttccaggagccacatctgaagagcatcaagcagcccacatgctccgtggccagctccccactgacgcggggggatgaataacagtcccagccatcatgtgcatttgctaaaaataaactgacatactttttgcattgggaaacaatgtggattccaaacattctcaaagggcagagaggggaaaaaaggaagaatggaaatcaagttttcgagcttagcaattaattagtgcctgtaaacaaatgactcatgatctttcctgactatttttctttccattttgcgtggattttcgcagggactcagggaagaatgccaaatgagccaagctgataggcaagacaggacccagatgggactgtcttgagggggcgttgtccagttggagagtgtgaggaagagcatcaggtggaagaacaacatgtgcgatggctatgaggactaaaagatcttggcatgtccaaggaacactgaggaggcccatgtggctggagtagaatgggtgaaggggtgaggtcagatagatccacgggacttggaacatacagacccttagtggtgtattaaggcatttatatttgatctagaagacagtgggagccatgagagggttttaaaccaggaaagaacatcatctgatttatataatggtgtcatgtaaaaaacagatgatcaggccagacacagtggctcacacttgtaatcccagcattttgggaagccgaggtgggtggatcacctgggtcatgagttcaagaccagcctggccaacatagcgaaaccctgtctctactaaaaatacaaaaattagctgggcatggtggcaggcacctgtaatcccagctactcaggaggctgaggcaggagaatcacttgcaccccggaggtggaggttgcagtgagtggagatcgtgccattgcactccagcctgggcaacagaacaagattctgtctcaaaaaaaaaaaaatcagaaaaatatattctacatgttctctgttgtttagatgcttctgatacttagatttcctcaacaaatgattatctaattgttatgtttcttaggggtttacacatgtaatgtttgtttcctctccttagaacatcagccctatgataacagggaccttgtcggtcttgtttacttctgtgtcctcagtgcctagaccactgctttgcacacagtaggagctcagcaagggcttttcaagagaatgaacactctgtgcaatgtcagaggcctcattccaccttacagggcagggaggtcttccaaggccagtctggatggtccccaggagaggcaggttttatttagttcaaaataagaagaagttttatggctggaacatcgattctgcaaggaattgaaccccctggtaatggggtcattccagctgggcccatgctatcagtcccacaatggccctctctgatttaagacagtctctgtgctgctcatagagtccactcaaagatctatgaggttggcatgtggctatgcccattgtgcagacagagaaactgaggccagggagtggtgacatgctcaaggtcacatggttacaagtggaagagcctggcttggaatccaggtctgactataaagtctgtgtttttaactccttctctgagccattgacatgggttccaatgcctgctccaccacttagatgccgtgtgacctggggcaagtcactttgctttctgagcctcagtgttttgctccatttaatgggaatgcggccccttgcctctcagggctgctgggggtggcagggaggtctgagccggcacacagatgttcgaatcacgtgcatccctcttccctgccaagctccttcctgggtccttctgccactggcccccgtcctgggctgccgaccccgccttaggccagaagctccttggagtccaccctccagttctccccccgcccactgggtgttgagtcactcatgccatgagcttcttgccctctgcctgtgttttcttcctccttttcttggtaaaaccactgccttttctgattgctaaagctcctcctagggagcaggtgggtggcaggggagaccccaccatcccacagaaccgtctccaccgcttccccatccctcccactctcaccacgccaggctgaggtcactgagcacgaggcctggatggcagacatggtcaaggttgggggtttaattaatcatcagggagcaggcagggctctggctggtccagggccccttgtctgggtataggctggtgggtagactaggggaggtcaaagtaaatattctgggaatgacgttgcttgcagcccatggcaaacacaaacatggaaaagcctatggggatgtgcagtaatggggatggggtggcagaggcggggatggggtggcagagacagggatgagtcttgagaggcttcatggaggaggtgtgtctggagccaggtttgtagatgggagatgaaggacatgggtgctggggccagctaccctgggcttgaatctcagctctgcacctttcccactgtgtgaacttggtcaggttcatgtccctctctgaacctcagtttcctcattttgaaaatggagatgattggctgggcatggtggctcacgcctgtaatcccagcactttggaaggctgaggtggccagatcacctgaggccaggagttcgagaccagcctggccaatatggtgaaaccccatctctactaaatacaaaaattagctgggcatggtggtacacacctgtagtcccagcttctcgggtggctgaggcacaagaatcacttgaacccaggaggcagaggttgcagtgagccgagatcacgccactgcagtccagcctgggtgacagactaagactctgtctcaaaaaaaaaaaaaaaaaaagaaaagaaaatggagatgataatatttacatccccctcacagggtgtggtgatgactgagagatgatgcagatgaagtatatagagcagggccaggcatatagctggtgcacaatacatgctagctattttcattcttactagtggcatagtagaaagcactggaattttagcttcagacagacctgggtgtacatttcagtgttctgcatctccctgttcttgagcaagctcctcgcctgtttgagcctcagtgttctcacctggacttggagatggtttcacttcatgaggtttgtggtgaggatgaggcatgaaattcctgtagattgctcagcacagtgctgggcacacggtaggcactcgctaaggagtggttggcatccactggtctatggcccagtggttaaggcaagggtttgtatatcaggcagacctgggtctgagtcctggctctgcccccatgggctgccgtgaggattatatagagctctagatgtaaagtacccagtttggttcctggtacctaacaggtgtgtggacagtgggaataaaatcaggatctttgtgactctgaagaccagtgttaggccaccccgacatcctgggtgggaaggtgactttcttccattgaaaggtggggaaggctctggccctttcacggtaaggaaacagtttcagagaggcgacatcactagcctaggtgggcacctgggtctgcttgtccgtagagcttgtctttccaaaaggggaaatctctgggttgagggtgtcccatggggccccttgagtgtcactgtgcatgctgctggaacagcctttttttttaagagggtcttactctgtcacccaggctggagtgcagtggcgcaaccacagctcactgcctcctcaacttcctgggctcaagtgatcctcccacctcagcctcccgagtagcttgggacgacaagactgcatcatccgcctggctaatttttaatttaattttttgtagagacagggtcttgctatgctgcctgggctggtctcgatcagtgatcctcctgcctcggcctcccacagtgctgggattacaggcgtgagcctccacaccctgcctggaacacccttttagtggttaatgaaagcaggtgacacataccgtgaagaaggcaactcttggcatgaggttctgggacccagcagtgttcagggcccgccaccccagactggggaccagggcatggctttgtatgtatgggaggtggcttggggtcttggggttggggcagaccccaagaggcctggcctgggcctttttccctctatccaaccagccccacagcactctgtccaattgtttatttcttgttactgttgggcgttttgaggcatttcttccaactgtccagaatccgaacctccttcctatgtgtggagaattttctgctgtatgaggcagatgttctgtctcccacaaaggaggctgtgaacatgagcctcagattctgccccctgtggccagagcatggacaattagctcggccatctaggtgcactgtcctgggcccctggggagtccattcagggtccatccagaggcttcatttatgcacgtcacgtccttctcctgctcagaatcctcccatagctccccattgtcctcaggatagacttcaactcctgcccgtgtcccgcaagatttgacgtgatggagctccactgaccgcccctcctctccctttcacccctccaaccacaggaacctccctcagctaaagtcaatatgccgagctggtacctgcttcagggcctgtacgtttgttgtttcttctgttactatatctcatttcacaggtgaggaaatggggctggaggaggggagaaggaaacagggcgtggtggaaggagaactccaactgaggttgggctggccttggcctgggcctcagccttgtggtaatcacaatccacgccagagactgcctcctccaggaagtcaaaacagatcctttttgtagacggatccctctccttgcctctgctcagcctgacttaggcattctctcgggcatttgggtgtgtgtgtgtggaggtgacattgcccccacaggggtggaaattaattcttatggggtaaaaaacatcttaatttttttatgtataaagcgaagataggccgggtgcggtggctcatgcctgtaatcccagcactttgggaggccgaggcaggtggatcatttgaggtcaggagttcaagaccagcctggccagcatggtgaaaccctgtctctactaaaaatacaaaaattagctgggtgtggtggcaggtgcctgtaatcccagctactcgggaggctgaggcaggagaatcgcttgaactcaggaggcggaggttgcagtgagcagaggtggctccactgcactccagcctgggtgacagagcgagactccatctcaaaaataaataaataaataaataaaaataaactcaccttaacttgatttgaatccacgcaatacctcaactgaattcaactcaacagaactccactcattgtgtttagttgaactcgactcagcttaatgtgtctccactcaaccctcctttgctcagtttgacacaacccagctcatcagcacgactgacatcagccctgcgcccctccactcagcagagcgcagttcaggtgaaaactcacctctacctgactcaactcaacccaactaactctgcttaactcacctcacctccgctcagctcagctgacctcagttcacctcagtttacttcagctcagcgccactcactgcaatcccacccacctcagctcagctcaagtcaatcctgctctgttgaatgctcagctcagctccacccagctcctcaacacacctcatctcaacttttacaagtttttttttttttttttttttgagatggagtttcgctcttgttgcccaggctgaagggcaatggctcgatctaggctcactgcaacctccgcctcccaggttcaagtgattctcctgcctcagcctcccgagtagctgggattacaggcatgtgccaccacgcccggctaattttgtatttttagtagagacagggtttctccatgttagtcaggctggtctcgaactcccagcctcaggtgatctgtccaccttgggctcccaaagtgttgggattacaggcgtgagccaacgcacctggccaagtttttatttatttgttacctttttagagatagggtcttgctctgtcacccaggttggagtacaatggcaagaacatagctcactgcagcctcgacttcccgggctcaaggaatcctcttgcctcagcttcttgagtagctgggactacaggtacatgccaccatgcctggttaattttcaaattttatttgttgtagggatagggtctcactatgttgtccaggctggtctcaaactcctagcctcaagtgattctcctgccttggcctcctcccacagtgctgggattacaggcttgagccactgcacctggctaaagtcagtttaagttaagtgtattcactcgactcacctcaactctctcgactcacagtagacccccactgtgattgccacctgccttccccagacagcctccaagccttgcagagaaggagttagcctccaggtgttcccagtttagctggggaccctgacatgtcctttcagctggtgctgtcatatgggaaacacagggcaccgcatgagcagtctgtggcagccccagaaagccccagatggttccccacagaaggaagagtcagcgcaggcagaacagtgggaggaagggtgtcctgggcagagggaacagcacgtgcaaagtggccgaggcagggtggatggaaccctctgagacccagaggttgctccagctggagggaggagtggagaatgaggatggtgtaagtgtggccgggggacaggcacaatcccccagggaggacctggcctggacagggggagacactgcagtactgagcagagaagtgtcattttaaacaccttcctggctgctgggggacgcatagagctcagaggtgagactggacttattgtgtagggacagagccgagaaatccagcgctagggggctggtggggagcagacaggtggggagcttaaggagagagtttaggaaattaaccataaaaatgaccagaaattgagcacttattctggtccagtccttgtttccttaccttacaggtatcaatgaatttaatcctcacaacgattccatgaggtaggtattattatcaaccctattttgtagatgaggaaactgaggcccagagaggccaagacatcctaaggagcggaactgggacctgaacacaggctttggtgctccagaggcctcaggagcagccggacatcttatgcaaaatgcccatggcaggtgcctcctggaggccggcccctgccccccagcacacagtaggtgctcagggccttctttctctgtttgtgggatttaaatcatcatcaccacttgagttgggagtgcccgtccactattcaaagggagaaactgaggcccaaggaaggatttgagacacgggtaggaacatattctacagacaggcaggtggtatcactggggtcttcttcagccattgggaattttttttttttttttttttggagaaagagtctcgctctgttgcccaggctagagtgcagtggtatgatctcggctcactgcaacctccgcctcctgggttcaagtgattctcctgtctcagcctcccgagtagctgggactacaggcacacacccccgtgtctggctaatttttgtatttttagtagaggcagggtttcgccatgttggccaggctggtctcaagctcctggcctcaagtgatccacccacctgggcctcccagagtgctgggcagtggcagggttacaggtgtgggccactgtgcctggccatcattgggattttgattcaacgtgtgtgcattgaacggccctgtgtgctgctgtggggagaggatcccaccttcgtccctccaatgctgagaattctcccgtggctgccctccgtcccgaggatgcaatctgggctcctcactgtgccccaagaagctctgctggatctgccccagcctcccctgcctccctggcctcacctcccatgactctgccttcttgcccctgcaccagcctcctccagcagcagtctcccaccccaggacctttgcacgtgctgtccctctgcctggaacactctcctcatgacagccccatctcctccatgggtcctcaactctaaagttgcctcacttcctcagtgtggcccccccgagcacctgaactgaagccccccagttcttatgtatcacatcacctcattgttttgcttttatttttcaatgttctgcttccttgctggaattttcctgtctatttcctgcctcctgcaggggacagagctactgtaggcaggatccctgtgggtcttgttccctgctgtatcccacagcccagcacacagtaggtgcttaataaacattcgtgggatgaatgaatgaatgaatgagtgaaggaatggatggaaagagcttaaaaatgtaggtgtggagaggaggactggcaggcctgggcccaggctggggctgaggcctcctctcctgggtctccctgcccggaggaggggcccctgccagggcaggagggtgggtgttgggggcagggagcagggctgggcgagccttctctgttccactgttttcatcctttcggtaattatgggctcagacactcctcgatgccttcccagaataatagccgggcctgttatcagtggcatctctgggaccttctcacaaacagtcattaatcaagtctcactgccaccctgccctccctcttggttgaagccgaggcacagagaggtaaggccattttcctagtgccacacagctgacgcagggaggatgggctgttttgccctgaaccctaaggtgcagggtaggggctccttctccctgttccacgtgggagaagtctctgagcctgccatgactggggggccctgcccccaatttcaggcccccagccctccttgaggcctcaggggcctcccaaggtggcctcttaatcattgccagttaattaaggaggttaagcagctccccggggccgaggcaggcctgcccagggagagaggtggcagggcccggactgcatctcacactgaggcccctgcttcccagcctgagtctggcatgggcgttgtgtctctgtggtgcccatcaccggacctgggggtctctgggggaggcgtggggcctccgatggggccatagagttccattgcttgggcagtgccccctccccttcttcgggggtgtgtgggaggtgctggcatcacttaatgaggcctccgcggctgccaaggagagctggaggagttgaaacaggttctgggtggggtgagtttcgtgggctgggcagaatccatggctccatgccatgtgggcgctccccagggcagtgggggtgggcaggtgtgggacccccaaatggcccctgtgtccagccctctgccctgatgggtgggagcagaggaagcttgggaggggattgtggagatgacagaggatgacagacaggaatggaggttcacatcccaccctcctaggccccccactgcccagcctgtggggaccacaccaagacccaccatgctggcagcatctggggctccggagacattgctaatgtgtgctctgacacagacttgggcctcggtcttctgacctgagaaataggggtggttggatgggataatcttgggctcggagctttagtttcggaatgacccatctatagcagagctgcctgacttgctgtgcgaccttaggcaagtcgctttcttcctctgggcctgtgcagctccggctgtgaccccgtggtggtggggtggacgcagtgatccttatctccgctgaggttgccagtgcttcgcaaggggcacctagactgctttctccaggattcttccagcaaggaaatcattcagtgcatctctcccggccctggggaagcaccgaggctctggattcaggccagggaggtttagaaggaagctccccaaggccaggctgtgggtcctggggtctggagggcagcccttctgtgttactgaatcctcggggccacttcaggctcaggtgaggctggatcaaggcgggacccagagcccatgggggccccgtgggttctttgtctttcccactgttttttcaggtcacttttatggatatataatttatatacagcacgattcaccctttcgtggtgtgcagttctatgaatcttgagaaacgtatacagttgtataaccagcaccatcaagatacacaatattccatcacagcaaaaagttccttggtgcctcctttgttatcaatccctttcctactcccagcctctggcaactaccgatctcccccaactttttattttgaaaaatttcagacttggagaaaaatgccaaaacttcacaatgggccaccaagtgtcccttcccccagaatccccgactgcgaacacctggccccatgtgcattcttggtcttcctctgtgtgatttttgctgagctgtttgagagtaagttgcagacatccttacccttcaccctaattacttcagcgtgtgcctccgaaggacaagagtgttctcccacgtaaccatagtgccaagatcactcctgagaaatttagcattgattcaattacattacctagtctccaggccatgttcaaatgacttggactgctccaaagtgccctttataaccatttttcatctgttttttttctttatttttcctggtaccaagggttaggccctgcctttggtggcacatctctttagtgtccttttatctgggacatggaacattctcccggctcttgcttgactccttttttttttttttttttttgagacggagtctcgctctgttgcccaggctggagtgcagtggtgcgatcccggctcactgcattgcttgactttttttaaaaaccactctcatggtttcctataccaggaactgccaggggaattccctggggatgtgagtgccaggaaacgggggctgctgacttgggggacatgggatgttcttagggttttttctgaaaagtcttgtttaaaagtaaagtggcagtagaaggagagagagacttgggttcattggctcaacttttaagaatgctgaaaattcaaagcaaaaagagacactacccaatttgcaattgagaggcatctctagtcctgtggttgaggttcaaatcccagctctgcctccccttggctgtgagcccttggtcaggtaacttcacttctagagcctctgtttcctcatctgtgcgatgaggataatagcagtctgtccaccttgccctgttgttgtcaggaaatgaatcaatgcatttagtgcgtgaatagtagcaacttcatttgctaatttgctgatagtatttttagacatttctctctatagttacagatatatgtgggatatacttacagagacagctcatggatatatgtgaatcatgcattatataaattaggccatcttcttttctctcaatactttatcacaagcattttcctatatccacaaatggagcacttgcgcatcgtgtataactttaactcattttgtccatagataataccatgtggcaccaaataccaaaggtacaacaagcgtgcagtgaaaagccagtctccctcttacatttgtcttcaccctctcagctcctcactgtgacagtcttttgtgttgcttttcagaagggttctgtgaacatgtgggcaaaagcatgtatttgctttgctttcttacagatatcagaggactctacacactagttctgtgccttgtgattttcagcaacagtagatcttgatgatatcagtacgtagagagcaccctcctttttcaaggctgtgtggcgttccatggtggacacagagcaggatgtaaacagccagttccttagtgatggtggcttgcaggcttttgccatgacaaattgcaactgtgttcttgtgcaagtatatccatagggtacatcctagaagtggaattgctgcatcaacggggatcacgaggtcaggagatcgagaccatcctgggtaacacagttaaaccccatctctactaaaaatacaaaaaaagaaaaaaattagccaggcttggtggtgggtgcctgtaatcccagctacttgggaggctgaggcaggagaatggtgtgaactcgggaggcggagcttgcagtaagctaagatggcgccactgcactccagcctgggcgacagagtgagactccttctaaaaaaaaagttatatatattttgaattttgacccaccatcatttttattttatttatgattattattatttttgagaccgggtgtcactctgttgcccaggctggaatgctgtggcacaatcttggctcactgcaacctctgcctcctgggctcaagccatcttcctacctcagcttcccgagtagctggactacaggtgtgagccatcacgcccagccaatttttgtattttttgtagagatggggttttgccatgttgcccaggctggtcttgaactcctgagctcatgcaatctgcccacctcggcctcccaaagtgctgggattacaggcgtgagccactgtgccggctgccaccatcatttgtaatagctgcacagatcctagtgtatttaacagtaccctactggtggacatttaggtggttccaacttgcccttcctataaacaatgccacaatgcacatctttgtgcagccgcctttgtgtgcaggacagtcagcttatggggaattcccgggatcaacaggaagtaccaagaaggggaaactgaaccgcaggggccagcatgaccccaaggcctgtgggtatggatggtggctggactggttggatgggtatggatggtggctggactggctagaggcttctgggctctccctgtccccggtgtggccaaagggtcctagagtactggactcctctagatcctcactgctcaaggtgtggcctgggagccacagcattgaccctacctgggagtctattagaaatgcagggtctgggtcccccctaccccaaaaccctgttaaatcaggaccaacattttctttctttcttttttgagacgggctctccctctgctgcccaggctggagtgcagtggcgtgatctctgctcaccgcaacctctgcctcctggttcaagcaactctcctgcctcagcctcccgagtaactgagattacacgtgcacgtcaccatccctggctaatttttgtatttttagtagagacaggtttcgccatgttggccaggctggtctcaaactcctgatctcaagtgatccacctgcctcagcctcccaaccaaagtgctgggattacaggcatgagccacagcgcccagcctaggatggacatttttacaagtctgcaagggattcaccagcacagctgaaaatgagaagagctgccctaaaacaaacctagacactccaagactggagagaatggctcagccttgggtctggggcgggcctgaggtcacacctggcttcaccgcctgctggctgtgtgatggaatgcaagccggccaacctctctgtgcctcggttttctcatctttaaaacaaggaatgagaggatccctcctctcacagggaggttgtgagaatcaagcatgatcgttcacagaaaagcgtttagcacagtgtccgcacttagcaaatgctcacccaaccctgtgattttgatggttatggaggctcacgttacggaaggcgatgcgggagtcagatctgtctgagttttggtttctgctctctccatctctgtcactgtcactctccccgtgtctctccagccctgttgtctcttcatatccgcttatttctctctgttccgccaccgcccgcttcctctgtctcggtctccttcttcctgtctctcagggtctttgtcctcatttccacctggccataggagctttgcaagcatctgtgaaaatgctaaacatcgggaaaaatggagctaactacaatgataaaagtgcaaactaaaaattaacaatactagaaaagcaaaactatactattataaaaactcaaaaacagtaacaaaaattatgtttttggtaggtcgtggggcttttccagcccatttgatgggtagtggcttggagctgcagggctgcggggccctgctgggggttgcctctctttcctgttttttttttttttttttttgagacagcgtatcattctgtcacccaggctggagtgcaatagcgcaatctctactcactgcaacctctgactcccaggttcaagcgattctcctgcctcagcctcccgagtagctggtactacaggcctgcaccaccacaccagctaatttttgtatttttagtggagatggggtttcaccatgttggccaggctggtctcgaactcctgacctcaagtgatctacccgccttggcctaccaaagtgctgggattacaggcgtgagccaccacgcccagcctctttcctgtttctttggaccccttgcagccttgaacctaaacagagctgagtgattcagtggagatctggcctcagctggtcactgatccccttctctgtcctttcctcactgcatggccctgggaaggcacagccactgatctatgttcttccaactcatttactaagtgcctacaacaccaggccctgggacacaacaccgaacaagatagacacaatctccgccttttggtgcttatgttctaggacggtgtgcatgtgacagatgatatggatatgagtgaataaacatgcggaacaattgtatggtgctaagttgtggttgtgtgatagagaaaggcgtggggctgctttgcactggggatgagggtggggatctgggaggatgactctggccgaatttagagactagaatgatgagaaggagctgggcctgggaatagctggaagaaggacattccaggcagagggaactgcaagtgcaaaggctctgaggcagggacaaacttgggggtcagtcatgattgggagatcttggaggaggaaaagatctcaagagaaagacagtctttctttgctgagtgtctcaagcaagttacttgccctctctaagccttagtttccccctgtgtaaaatgggaatgttaaagacacaatcccaagagatgagtgagttttaaatccagtggtgggccagaatttctatactggagggtcttaggggatggttgggctatggggtgatttgtcttgaatttgtgggcttagcagcactactctttttacttggtttacttgggcggctttggggggtgatgatggagattatttgtggttgcaagtgatgccccaatttccccatggccgagcccctgatttcaggagttaatagcctacagcactcggcacagtgcctggcacagagcaagtagacaggaatggggagggcattccaggtgggaggaaaggcgtggagatgggaatgtttaaggcgtgttaggggaagagtgaggagaccagcctggctggtggggacgggtgagtgagaggctggaaagacgggttgaggaccaggatgagacctcgaatggcatgcaaaggagggtggccacagcccggaggcaggaggaagccactgtgagctctggagcaggagaagccgtggaaataggctttgtttctggtttgattctcaatatttttaatgttttactattcaaaaaaatttaaaggataagaacagaagtttccacgcagctatcactcaactgcctggaaacttatgttcttctgtgttcttttcttccttaaaaggaaccaccccaatataggggatccccccatatccctgcccagaaggatctctcttagaagtcactgcaacctgtgagctgagattgcaccaccgcactccagtctgggcgacggagcaagactccgtctcaaaaaacaaaacaaaacaaaacaaaaaacaaaaaataaacaacaaaaaaaccagtcactgcaacctggatttgatgctcgtgatttccctgtgtgtctttatccttctcttgttggtttgatgaaggtatccacctggtttgatggaggtgtaaatgcacacagtaaaacacacagatctttttttttttttttttgagacggagtctcgtcctgtcgcccaggatagagtgcagtggcacgattttggctcattgcaacctctgcctcccaggttcaagcgattctcctgcctcagcctcctgagtacctgggactacaggcccgtgccaccacgcctggctatttttttgtatttttagtagagaaggggtttcactgtgttagccaggatggtctccatctcctgacctcgaaatgcacaaatcttaattgtagtttgatggtcatgggatcacaccagatcaagatgtagaacattcctagcctccaggggctcccttcaaaggtaactactggtctgattcctattacgatagattggttttgcctattcttgaacttcatataagtgagcccattcagtctgtgctcttttgtatcaggcactttcacttaaactcatccaatgaggtctatccaagttttgtgtctgttttcacggctgtggagtattccattgtctaactagaccacagtttgttgaatcaccctatggtcaacagagatgggggttgtttccagtttccactattttgaatagtgctgctgtgaaccttctcttacacatccgacagtagacataagcaggcatttcccttagtctatatccaggaatggaattgctagatgatgagatatgcacatgcttggtttttgtagctatggccagtttcccaaagcagttgtaggacatctttagacttttacacacacacacacacacacacacacacacacacacacacacacagacacacagacacacgtggaatccctgagggattcggggagctgctttgggttgtgggtgggattgtacagatggcgtcccttgtacatttgcttctgcatcctgctttttttccacccgatgttctgttctggagttccgtccccgttggcggagtggcttgggtgcatctattggttgtccctgtgggctttgtcgtggggacagaccacagtgctcttcctcaggcttctgctcctggacatttagcttattcccgactgggactctctttttggcttttcatgaatatccgttatgcgttgggtgaggccagctaggactggccgaggtgcagggtggacattgggtctatcgtggtgggagatggggacgaggggctggtggcacagatggtttcaagggacttttagggaacttggttatggtgggggaagaaagaaacaagacgggggccttgggggccagaagcccaggtttaaatccctggtcccccctcctagctgtgtgaccttgggcatgtgactttgcggcttggagcctcagttacctcatctgtaatttgggaacatcaaccctgcctgataagacggttgtgagggttgagtgagcacagacattcagtggacctggctaggatttgaacccctttattaactgattgacctcgggcaagttgcttcacctgaacctcagtttcctcatctgtaaaatggggatgataataatacctgcctcccagcaattttatgatgatgaaatgagatttcggacataaagcacttactagatgctcaatacctggcggtctcttgttattattactattgcggttgacttctctgcctttccctccagaaggtgggtggctaaacagcaggaattggtcttttgtccccaccttcctcctgtggctcccacacaggacagaggtgagggtcatctgcatccagggtgtagacctcgagtgagccctgcccggctgggagcctcagttctctcctgtaacaggggctcatggcagtgcctacctgaccaggtggcttcccaaggggcacacgatcttgttggggagaagagctggtcaggagggacctgtggacgggagacattttccgagcaatgttgtggctgatgccatctgggggtcctcccagagatgggcgggggatgttgggctgagcccctgaggaaggaagacatggcgtgggagtgtaagaagggagaagaggaatgattccagccctgctgacctcctgaggggaggtttcagctgcagggatgccagagccgcttgctgcagcggggacactcaggccacagcgagaggaaggctggagtcctgggttcccaacttgccgctgatgtccttgtgctgtgtgaccctgggtgcctgtcactcttaccctgtgccttggccttcgttcattgtgagaatctcagacttgctctctcttctgctgggtttcccggcccccgcagaccccctggcctggcccctctgccctcatggaggccgaggccagggcccagggccagggctgcgcaccttgacaacgcgcccacgccgggcacaaaggcccattgttcgggcccacgttggcggggaagcgggcggggagcagccgcctttcacccaacccgcttgtggtcggcggggactgaggagcgattcacagaggcccccgccccctgtccgggcatccagccaggatgcctcccaggcaggcacccttgccaagctgggcctgtgctacccagaactgggcctcagtttccccagctgagaaaagggaagcagagcagctctgatagtggggtagagcttgctgtttggcctcattgccctgagatccactgctctgtgccttccccaggcacagatcagctgcccctgacatgccagaggaggccacgggatctggggctttggggcctgacaagtctgggtttggattcatgctggatgattttgggtgagtctgttcagctcatgagcctttgttctcccgcctgtaaaagggggcttggagtccatgatcctcagaggtaaaatgagagaaatgacacctcagggcggcattcattcattcattcattcattcattcattcattcattccaaaaggtgtactggctgtcaactctgtacaggaccagctatagaatgttcagtgtcgtgtgcaaaattaaacgtgatggtccttgttcaaaattaagaatttcaagaggtaacggcattaatccaagcatggggccctgtgtgaaggcatgcgttgcaggtctgtgaggctcactctgcctgtgtgccagccgttatcccaggcaccaggaccaggcactgggccccactaatgagagagggaaaaatttctgttgtcatggagctcataacctggcagggggacctagagtccctgaaccttcccaaggccaggtgccccaggaggcctgctcctcctgggcctgctgaccaggccagcggggtgagcggaggcacccaagcttccttcgaggctccgatgtcagtgaccaccacatctggctgggcacccacaataataatggcttacatttgcataagactctgcccgggctgatccaggaccctttctcggatgaactcagcatcttcgtggcaaccctatgaggaaggcgaggcagcatggctcaccctttgtatggatggagaaactgaggctcaggctcactggaccattcagccagcaaatggcagaggcaggatttgaacccaggctgtctggtgccagggtcttcatttcctcattccatcctctgtggatggggacagcggtgagcgaggtggtttatgctggcaacagaggccctgctggggattgaggctgggaagggtgcgggtgtgctggtggcccgccagctgccacctgggttggccctgctgtgtggccctgagtcacagcgctgtgtcctgggaagctggttgtgctccgggcacccgtggggcctgagtcacagcagagcacaccctaccttcctgcctacctcccacctgggcccagggacaggcaggccctctgagcaggttcttaggcaggcagtcacatctctgcccaacgtcaggggcaagaaagaggcacctgtgtgtggctccagaagcacattcctgcttcctgtcactgagcccaaatccatccttccaagctaccctttggatggattagctggcaggtaaagtactgagctccccgtcactgggagcattcaaagcaggatagcctgtcaggggtgctgagaagtgttcctgaatcaggtagggcctgctgctggagtatgtgaattccaatgccctaaacatgtgcttatgtgctaatttttgaatagctatggtgagcaaatgctacaaaatccaaaagtagaaaggggtatggaatgaaaggcaattcctcactctctcctttccccagcctctgactccccctccttagaggcagccactgttaacctgctattttggccagagttaatttatgtacatacaaacaaatatctatgttgtccttgcctccctcccacccttccacacaaatggtagccaatatgtttcttacagtgttctgctcctcatttttttttttttttaattatttgacaacttatcctggagactgttctagatcagcacacagagctgcctcattcttcttacctagccacatggtattctggccccttcccttttaaaatctataactgatttgattaaaggaattttcaaccctgaattctacatattgggatctgcactgtcctttgctctggtggtggcctgagaacattttcaaaatttggctggagactataagctctttccacatccgtggggatttttgtgttctgtttttagttgactaaggcgagggcagcttttcattcacagctctccacgccaggcaggcactggtaatccactggtgagccccacgggcatcagctcatctgccgacagtgtggccaggctgtgggaggagtatgtggtggcagggagcccagaagaaagggcttcctgtgtttgtttaagtaaggggttagtgatggctcctcagaggtgggactatttgggcagggccttaagggatgcataggagttcctacgaggagaagtatggagatgggcttgccagacagaggaaactgcatgataagcgaaactgcctggtagatgcagaaactcctaccagcatccacttactgaacacctactaagtgccaggcactgtactacgtactttacaagtcattgctgcatttcaactcttgacagttgtaggctattactagtcccattttacagataggttagttgaggttagataggttagaaaagcccagtaacttgctcacagcaacacagctacaaatatcgaagcctgggtttgaacccaggcgacttgggctcttggccattctactatcccacaagggtcaaagggtagatggcgaggtcccgaatgctagatcttgacctttcaaccttcccagctcgggtcctgcccctgctcagaggcccttagttgttccccactactccaggactcatcggcctgagctgccctctccctccagccagggtgggcacctggggcagcatcagcctttctgggtctggctgggtgtgctgggtgctgcaggaggagccacacatggtactaatggagccagggagcaattaggggggcatataccctggcctgtgcccactgaccggttttggatgtagttggagatggaactggccctctaggctttgtcccctggaggcctagggactctgtcttcagggcagtgctggctgtcactttggcccagcccctctggcttcctggttgtgagcagcctctggacccagagaactgttctcccgtgtaccctgttgggcactgggcctggggctttttaaacctcatggattctgcaacgtgggaattcatccctccatttggcagatgaaaaaaagaaggttcagaaaggtgaaacgacttgttcaaggccacacagcgaggaaagggcagagccaggacaggaatccagaccctgagtttgactcataaccaccctccactcctgcctccgtgcaagaggattttccaacctgtctgctgcttggcaggggcttaatcaacctccctctctctctctctctcctggtcttcaggaaaggggcaatgagcccattgccacggggtacggcggagcttggatgctgcacccaggactgaaagggggacctgtgggcggcctctgcctctccccgcgcagcgtcaggacacaggcccacattccctcctggcttctccctgaagggagagagaataatagttggttcaaatgtcaggcctgctccgtgctggtggggagactggttgagcaggtccgcaggagggacggagggaggaaattattaataattgcaaagcaaccagccacactacaggccttgagttgtgtctgcgtttgtctttggaggtgtggagttgggggtgctgatcctggggacccagcccaggggtcaggacagcctggggaccagctgcagcttcccagaagcctgtgtgggtaggggagatgatgggggcacagagtcagccacctacccctggcaaggtgggacacatcccagcctccccatcttccactgactcagggaaggatctgtcaacatctaggggagggaggaaagagcctactacgtaccttcaggaagcttctcattaggtgatggatttaatcctcacaacaaccagatgaggttggccttgctattatctccagttggggaaactgaagcacagagggtctaagggtctaattgtacagatttgaatccaggaggtctgagtgcagctggatagtcctttgctgggatgggaggatccccattccctgggaacagccacacccattcccagaacatcaccacgatccctgctgccttcccttggaggacaggagttggtgtgaagcttctctgagcctcagttccctcatctatggaataggagccagagttcctccctccagggtcagaaggcagctagctgataaggggagcaggtaaggaggtgaagggtcggtttgctggctgctgcctccacctcccttccagaaccagtcaccagtgacagtcccttcatcaagaccctttctttcctcccttctccagcacccacggtgaggtctgaccaacagccgcaaccatagtggcgctttgctgagtcttccttgagctccctgtgtgcctaacgcagagcttctcccctccccggggctttggaaaatctgctctgaaatgtcttgtgagtgatcagtttacgcttcaacaggaaaatgagttgaatggtggaacttgaggcagggttttggggaatggacagtgggagttctgggagtctagagccagcctctgggcttggggttagcagggccgaggcatgcccagatcgcatgccatcaagccccaggaccagccgcatctgtggggtacctccagggcgtccccctccttggcctgccctgatgggctgataagacctagcctcggaggaggaggcagctgtaattacaggccttagtggtggcgggcaggcaagtcatgaggtgggggtgactcagacgattgctccacggacagggtggaggcgggggccacccatctgcccctcacccagctggcctgagatgggtctgggcacccagggagcggcccggccagggtcccatccttgggcctgtgacccaggcccctgtgccacttggcatccacgaagctggcattgcactggacttgggactggctgggttttcccctttcttcgtcccaggcaatagcttctgggaagtaggagtcagtgctcagaggcaccaatgggaggatcatcaggactggaccgagagagccgcagactcgggggagagtaccgggagtcccagaccacagaaagacagaacctcagccatgtgcagactctgagaaccagcagatgacggtttctagaaccaaatattttcaggttcaaggattcagggactagtagatctgtagaattatcgatttataagatcacggacctggttgcaattggttccagagaattcatatatccattgagatagagatttaaaaaaaaatcacagcagctgatgagttcaggagtaaattaccttggtgtcttcaacttgctcccacatggatcaggcaagaaaagcccccccaaaagtagaaatatgcatctttctcatttaacctagctagagggaaggcccgcagactgaagaattaacaactggtaaattgaggcaatcattgtactaatcatttgactgtctatgggcttaaaaattgtcaaaataaaaagccaggaaatagtaataaagaaaaggaaatgtgggtcaggcatggtggctcacgcctgtaattccagcactttaggaggctgaggcggtaggatcgcgtgagcccaggagattgagaccagcctgagcaatatattgagacctcgtttctatgggaagaaaaaaaaaagcaaaagaaaatgaaatgtgaataccaaccaggacattacaaattatgcaacttggtaatctataatattatgactttccaaatctatgcatctgttattctcttcattcactcattgtatattttatttatacacttttgcagagtacctacgtggtcacaaggagaaactgttctaaggctttacaaatgttaactcgtttaattcttatgacatttctaagggcattatgaatagtaactcattgaattcttacaactggatgaggtaggtgctgttatgatgcacgttttacagataaggaaactgaggcagtgagaggtggagtaacttgcttaaacggtgctcactgtgttattaagcctctactgtgtaccaggtgctgtgctagacagagcagtgaacaggacagactttgtccacaccctgggggaacttggcagaggagacagataataaacaagcatgattgtttataagttcaaagcggaaaataagcctgctgctttgatggaaggtgggggtatggggtccccaagattgagcgaacaggtgaggctcttctgaaaaggtggccttttgctgagacctgaagtacgaggagaaccctggatttgagagacatgactgtcatttgcctgggctgtgccctctgcctggactgccctcctgcttccggcttctctatgccaaccttgccttcactggtccaggtctggctgggcggcacctcctctggaggtgggaggtgaactgggggcttccccagccccagagggaatctgtcctccccctggtcttttctatcctcctggttcccagagcagaccttaaataagggaagcctccatgtgactcagcggcaccacctgtgccaggctctgtgctgggatctcacccaaccccgagtggggagcatagttttctcctggggaggagatagaggctcagagaggttaagagacttgcccaaggatgcacagctaacaagtgttcaaaggaaaatccacactcaggactacaggctgtcttttggtgactggtttacctgctcacctgcctgcctaccctgggcacctctcgagggcaggtcctgggtgctggagtcagttctgtgtaccagcatcgcccagccctgggtctggcctacatgggatgattttcccttcaccaggctgagagcatgagacatgaaggactaggccagggccctgggggctagctctaccccaaggggaaggtggacacgggcctgagcccctaggctcccagacagaccctgtgctggctcccgccctctgtcccccttcttccctggcccaaactggcatggtgccttccctggctctcttaggctgctctgcccagggctgagagggatgcaggggcccagatccctatccccagcagacaataacctctggggccactgagcagatggggaaactgagtctcagctgagtcaagcctgacacagtgggggtggggtcagggtccaggaatcttgtgggttcacaagcacaggcacagaggcgggaggcatgtgcacatggacacgcttgctgtgtacatgaggctgatgtgagccaatgaggacacaccattggtgcagatggcactgggaacacagccgcccacacacgcccatgtgcacacgtgtgcataaacaaccgtgagtgccttcctggtttaaatcccactctacttcttagtcttgctgagataccgcacttccctgggcctcagtgttcagatctaggaaatgggggcatagattgaagcctgggtaggctcgagcctggtttagccatcctggccccttttctgcatggggcccggggacctgccctggaggtttgaggagagggttcagtgcggtggtcttccccatgccgcagtggacattgggagcccccttggggcaaatggcctgtgtcactcaccactgggctggcccggactctgctccccaggctggttcctggcactgactggcataaggccaggctgcctgggtactcagctcccatgctggccacaggggctccaccaggcgttgggacagagaggtgtctagaaagttctgccttagacaaggggtgcctgtgtgcatgaggggcaggctccgctcagctcccctccccgtgactctcttgctgggggacttcgtagggtggaaggagcccaacaccagcgtccccaggctggattcaaggccagctccacgctctggggctctgaggcctgggagcctcggtcttctcatgtgcaaaatgaagagcatcaacccacctgccgcagggacaaaacaacagcatagtggctggcacacagtaggtgctcaacaaatgccagctgtctagctgcagactacggtcacagtttcattcattcatccactcattttgttatttatgtatttgagaccgggtcttgctctgtcatccaggctggagtgtagtggcgtgatcacggctcgttgcagcctcgacctcccaggctcaagcaatcctcccacacttagcctcccgagtagctgggattacaggcgtgtgccaacacacctggctaatttttcgcatacaaaatcccttctcgacgaaaaatactcctgggctcaagcgaactcctgggctcaagcgatccaccctccttggcctcccaaagtgctgggattacaggcatgagccagtgtgcttggccccatcattgatttaacctgtatttattgagaccctactatgtgtcaggccctgaggggagtgttgggatcacatcacagaacaaagcggacagaatccccgccttcccagagctgacagtctagtgggagagatgggcattgaatgagtaaacagcatcatttgagattgtggtaaaggaaatgaagcagagagctgggatgcggggtgaccagcaggacagccagggagggcctccaagaagcaggcatgacctaagagaagggtgctgggggtggatgagtggtaaaggtaagggccctgaggtgggaacaagctaggtgggtcaaagaacagtagggaggccaccgtggctggaatagggagagtgaaagggagagggctggagagaaggggagggagtggaccctgcggggcttcgaaggcaggagtgaggaatttgaatttcattccaagggtaattattatgaacaaagaccaaagttatgaatgactacgagacacaaaatgcaaactcactgtgattcacttccagcccagaacttgggcactttggatcaggaaacttaaagaaaagcacctgcacacacaacttctctgtggctagttttgtttatttcttgtagagatggggtctcactacattacccaggctggtctcgaactcctggactcaagcaatactcccactttagcctcaagtgctgggatgacagatgtgaaccactggccaggctatgacgttcattttagaaagaaatacaaaggtaacaggcctttgccatttgttgaatgtaaattcagagcgttacacacaaatgcgagtttgttagttgcaaaggcagtcacggtctctgacttcagtgctggttgtgagagtgaggtgagctggggagggggcatgatatcaccagcccggatttcaacagtgcaatgccaattggggaaggcttgggagatcagctggtccaccccactgactcccagatgaggaaactgaggtccagacgaggggaagtgagtggccaaaggtgacactgtgagtcagaggcagatgcgggacttgaacccaggtcccctgactcctaacccagactttctgagaaatgagtgtcttgccacgtgcttcccctttgccctttcctcctggacagtgtcagctgtccttggggccaggaaggagacatggaggccaggggtttctggtggaccccaccacagggcttctcatctgaggcaccgctgggatgttaagccggatggtgctttgaggtagaggctgccctgtgctaggccttcaggccatttttcagacaggatcgggacttggagaccagggcccagggatgccgcttgaggtgacagaactggaaaagatgaagggaagaaaggaatgtaacccacattgaataatgaagcctgacgctttaaccctacaatggccattgctggatgttgacgtaaacaataggtgtctacaggatgaattagccaaacgacaactccggtgtgagcagaacgggctcattgggtcaagacacaattccaccacagaacgggtttcacaaaggaccatgtcccatcaactcagcaatgaaaccatcgtggtctggaaacctgagatcaggacccacagaatgactggcggaatgacagaccaaatgtggaagatgttccaaccaggtgtgaaaaagtcattctgtgaattatgagagtgtgggaaaaacatactcactggaaaaaaaatccagttgttaagatagattgtttatttatttatttatttttatttttttgagacagagtctctctctgtttcccaggctggagtacggtggtgtgatcttagctcactgtaacctccgcctcctgggttcaagcaattctcctgcctcagcctctcgagtaggtaggactacaggcgcagtgccaccatgcctggctaatttttgtgtttttagtagagacggggttttgccatgttggccagactggtctcaaactcctgatctcaggtgatctacctgcctcagcctcccaaactgttgggattacaggcgtgagccactgcccccaaccaaaatagagtttatttatttattttttcttttgggatggagtctagctctgtcatccaggctggagtgcagtggcgtgatctcaactcactgcaacctctgcctcccaggttcaagtggttctcctgcctcagcctcccaagtagctgggattacaggcacaagccaccgcgcccggctaatttttgtattataagtagagatggggtttcaccattttgaccaggctggtctcgaactcctgacgtcaagtgatccacccgcctcagcctcccaaagtgttgggattacaggcatgagccaccgtgctcggccgatagactttatttttaagagaagttttaaatgtacagaataactgaaaagattgtaccttatgaccagtttctcctattattcatgtgtcacattaatttggtaggtttgttaccatttttaaattttaagtcttttgaggcagggtcttcctctgttgctgaggttggagtggcacaatcatagcgcaccgtagccttgagctcctgggctcgagtaatcttcccattttagcctcccaagtagctgaaactataggcatgggctgccatgctcagctgacttttgtatttttttttgtaaagacagggtcttgctatgttgtccaggctggtctcaaactcctggcttcaagggatcccaagtactgggatgacaggcatgagccactgcgctccacctttatgttataattaatgcaccagcgttgatacattgtcgtgagctagagtcccatagcttattccgactgccttaatctttccctaatgtccttcttctgtccccggagtccatctagggtatcacgtgacatttaattgtcatgtccctttaggcttctcttgtcataacaatttctcagacttcccttgtttttgatgaccttgacggttttgaggagttctggtcaggtattttgtaggatatccctctattggaatttgttttttttttgtatgaccacattagggttataggtttgggggaagaagatctcagaggtaaaatgtcattttatcacagcgtatcaagtgtacttactgttaatgtgacttccaactgttgctgttgacattgatcacctagcctgagtagtatttgtgaagtttctccaccatcaagttgctattttttcctttttccacactgtactctttggcaagacgctgctgtgtgcagcctgcgcctgaggtgtgaggagttatctcccctcctttccactggagcatctatgtaaattatttggaatttttctgcatgagagatttgcctcttcattcctatccatttattcaatattttatttatatcagtacagactcacggatatttactttatttatactttgggttataatccaaggttgctttatttattttcttgctcaaattctgctaactttggccattgggagctctttcaactggctcctgcccccttccacagacccctatcagtgtagttttcttgaagtcctttcatattttctggcactacaagttgttccacattcaacttatatatttcctgctgcagtcttagaatcagccatttctctaaagagtcctggttctttttattagagaacggtataagaaaccaagatctgggtgccgggtgtgctcatggctgctggggtatcatttcttttagcccttttcagctgatggagcaaagaaatatctgtgtgtatactaacctgtgtataaacacacagttatcaatatttccatgtgtaactagttatattcatgtttagctaaacatgagtttatattgatgtctccagaatccattatatgtgatgaatttaatcaattaatttttttttaaatatagggtcttgctttcttactcaggctggagtgcagtggcatgatcacagctcaccgcagcctccaactcctaggctcaagcaatcctcccacctcagcctcctgaatagctagtactacaggcaagcactaccacatctggctgattttaaaatatttttgtagtgatggagtctcactatgttgcccaggctggtctctaactcctcgcctcaagtgatctttctgccttggcctcccaaagtcctgggattacaagtgtgagccactatgcctatcctataatatgatttgaaatagtggtgcaacactaaattcataaccttatttattactacctgaacacttattatctgacaagtactttctaagtgctcaccacacatgatctcctttggactgcatgacagctctagacactggttctctgttcatccccattttacagatgaggaaatgcagacacagataagctatatatcttgcccaaagtttctcttctaataagtggtgaagtagaattcaaacccaggttcagtcgtgtcaaacattaaaatgtatctatatttcacattaaatagaattcatatacagctaagagaaaaaggtcaccttatggttgactggttgacgtagtattataatcacagtatttcgcttcgatgttctgatttccctgggagccaataaatttgtgttttaattctcaaagttttctgcctgaggctgtgttgttgctaatggccagtggatgaaagagctcttaggctgttcccagtccgtccagctgccatgttgactcaccgtcagtccctccctccagctagcccccatgggaaattcacaaggaagcagggtcttctggggaaaatgtcccaggcagctcagatccccggagggtcaatgagggagggacaggatgtgtaaggggaggaagtggggggtgcgagaacggccttggtgctctgccccctaggtgttcccagtgtgaatctggtctgacctgctgtgcttcttctgcccgggcttcttgaaggaggcctaccctgaccccaagagtggcctctgggtgacccaaccaaaggcccctcctgcttcttctcacataaggtcccctcctctcaaacccaaggcccagcctcttccacctcctccaggaagccttctctgtctaccccactctcaataatatccttgttccccgaaataaatatcaatcctggaccaaacgtctcacactagcagccctcagatgtactttttaggcctgtatcatgttttctaaacttttaatttgactcccagcattgaaaagcaagagatttcacctaaaaatgtgaacacacaccctctcttacaaatgtggaaagcctggcatcccctggccctcgttccttctggtgagcccagccctgcgcctggcacacagcctgggtgcaccagccacagccttcttggagcactggcttcagaggcacgcaggcccgatttgcccttcctggccatgggacatggcaaaaaatgcttcttgtgcagcctcaatttccccatttggaaccagggcttaaaacaaaacctccttcatggggttgttgggaagaagaaatgaactaataggtggagcgggcttagcacgggccaggcattcagaagcctggattaatgatatttcgttttcttgttttcctttttgttttcttgctttggtatctctcatttcctcatggtcctatccttccccactcagtctgtctgttcgtccatccatctgccattctacaaatgcctactgtgttccgggcacatggaggatccagttgttcccctcggaaaacccctcttcctggtctgcctgagcagagagccatttcatccacacatgcattcattcactcattcattcaaatgctcactgaataccgactgtgtgccaggaattgttcggaacatcaaggaaacagcactgaacgaaacagacaaaaatctctgctgtcctggggctgatgttctactggtggcagacagaccataaaccaattataatgtgaggtagcactaagtgctgggaagaaaaatcacagatgtggcgggggcagctgcttggtcaggaaggcctctctatgagcagggagggggccgtgtggctggctccaggataagaacattccacgaagagggaaccagtgcaaaggccctgaggcgggtgcgggcctggagtgtttgggggcagagcgtgagtggaggggtgtgagttacgtatttccgtgatgttagaattcctctcctccctgtcattctcttccccctcctctgctttctctctctctctcattttttttaaaacaatgagtctcttaattttgttatcagatacacaaggacaattcataaaaatagaaataatatctgggaagcggtgggcatgccattggcacacaggagtggcgatggctattcttaccatttcttctcatttctggcaggaatgaatcacttacttccaacgtttcctaaagaggcaatgggctcctgggccctttctcactcgggagggcctttcctctgccccatcattctgagggtttctggaaggtgagtgcgtaagatgtgtgtgtctgtgtgtgtgtgtctgtgtctgtgtgtgtgtcttgccaaagaagggtgctgttgcctcttccccttcgctcccctcatctcctcttttctatcttctgcccctttggtggaaagaagcatccaagcgtggggagccttgtttcggggccactgagaacttgctgagctgagcttgctgaagcttacgatagcgaggccagggtgggatgtggctcattgtgtcagaaaagaggttcatagaactcttgagaatgggagtcctagaaatagggccctaggcccatctgaagtcttctcacttgtccccagagcttcaggctccttcctgtccccccaccttcctggatgctgcctggtctagccccatcatcctgcctgcgccattgcagtcacctcctgcctggggcccctgcttctgccctgggccaccctgcctgttcctcacacgcagccagaggaccctgccagaaccaactcagaccctgtcccacccctgctcagagccctcccagggatcccaccccactcagaggccctgtgaggtcctgcgaggccctgcgtgttggctcctatctcctctctgagctcacctctcccactcaccgccttgccctctgcccccttgcccagccacactggcctccctgctacgtgacaggctcctactctagcttttggaccctactgcacccctcccaccccagggacctctgcccctcctcttggggtcagctgggcagcctgccctgtactccctaaccccctccaaccccaggagtggggcttcttgatgccagcctccaagccctttatcacgtgtccatgggcagtgttctgaggtgtcagccctagaaaggttggctggatctgggtgcactgtggtgccccagtgcctggaacagtgttggctgcctggaacagtattggtgcacaatatgcagtaggcattcaattagtgcttgctgaatgagggagcctcagcgttttaaaatcagaccttgaaaacgttgcaaagttcttagaatcccaggcttgaagaattggagactgggaggcagtgaggctgggtgagtctggaaggctgcgggcccatctgccccatcctggtcggctgtgtgtgtgtctctctttttgaatctgtctctgtctttttctctctctgtcactgtctctttctgtctctgtcttgtttacctccttctcattgtttctctgtgtgttgtctgtctctgtttctgtctctctcttttctctgcctcttctctcctctcctctccccacagcttccttccctgcccccctcctcctttcttcctctcctgtctcctcccatcctctccccttctcctttcctctctctctttccactgttttttctcttcctttctccccactgtccctctctgtatctctcgtttctctgtctcggtcatccgtgtgtctctcctccttgctgtcatcttctgtccctgcctccatgggcacccagccagcttctgctgtggagcgtttttctgcctctctgtcctccatctgccccacccaggggccctatccaattgtcacaaaggctagcccatggccagtcctgtgaggggctggtgctgggcgtggaagctcttcttgaccttcttacttgtggcatgactcgaaaagttgcgaacctttctgctctctgagctctgatttccttgtctagccaaagagaataacaatttctggtacttccttgatttctatgctaagtacatttattatttcactggctcgtggtgaagcttggagaagtttatgggtggggaacctcaccaacaaaacctccatggcagcagaagcaggccttgccaggagctgaccatgtgctgacctgggctgggcatgttccctggctggggcatggccgctgtctgtcctgggctcagcacacagtggtctctttctgcccagccaggcctcctttcagaaacttgaactcattaggctgcctccagccacagggcctttgcaggggctgttccttctgtctgggatgctcttccttctatctttgacctggttaaactggggccttcttattcttctgatttgggctcaaacatcccctcttccaggaagccctccctgatgacacccccccaagtcaggtcaccttgttaaccactttctatcccttaccacagttataattatttatttgctctcagtccccacagggctccccaccccatcttctgggcttaaggctccccaggagggaagttgagaggtccaggcccatgagtcagcagagcttggcttcccctcttagcactttctttggggcggttggggcctggcctcctccaagggggactaaattcaggggtgactaggtggtggggaggtggccaagtcctctctccgccccctaccccagctgcccagcatcagacaacttctctctgcttctgtgccaacacctgcctgagccactgttgacacactcacctcccccaccccagctccattgccaccttctcctggggaagccagagggagcttttcataatctaaatctgacctccaacggccgtgctccaaacccttccatggctccccgttactctctgaataaagccccagcccctcagccggcctccacgccctctgtggcctggcctggcctcttccccttcatgtcccagcagcccccagctcccagcagctccctgcccccaggtcttcgtgcttgttgtcccaccaaatggatgaaagccacctgttcactccctcacctccttcaagcccagacatcaccttcctagcgaggccttccctgacagcgcttcttaaaattgcagactccccaccatctttcccctgcttccctcctttatttctccctagaaccccagcctctgggaataggccatagagtttatggattcattttgtttttcgtctgtctcccagactagaatgtcagttccccacgggcaggtgccattgtttctcctcttccttactgtgtcctaaggaaggagtgagcgaggcctgtgtggctgtggggtcagatgggcttgggttcaagttctggctcattcactgcctcactttctctccttaagagctgagtaaactcttgtgtgtaaagtgtctagtgcctacacgtgtctagaggaaaaaaagccaaaatgagaactcgtcactcatgatttcggggagatgggtgatgctgcttaggcctggccacaccctggtgttgttacccggccattgaaaagtatgacccgcagccctcccaggacccttctgtttcgtttgtttgcttttaagtattatttgttacacaagcatttttttccctctagattttatttttaatgaaaaaattcaagggaaattagtgtatgtaatattccacccttgttttaaacaggaggtggaagatacatgtgtatgtttttaaattgaggaaaaattcacataacataaaagtaaccatttaaatgaaccattggccattttaaagtgaacaattcagtggcatttagttcattcataatgtagtacaaccatcacctctatctagttccaaaacattttgtcccctcccctcccctcccctcccctcccctcccctcatctctcctctcctccccttcccttcccttcttttttattttccagtctcattctgttgcccaggctggagtacagtggtgtgatctcagcttagggcagcctcaacctccccaggctcaggtgatcctcccacctcagcctcctagatagctgggactaaatgcacatgctgccacgcccagctaattttttgtattttttgtagaggtgcggttttgtcatgctgcccaggctggtctcaaactcctgggctcaagtgatctgcctgcctcggcctcccaaagtgctgggattacaggcatgagtcactgtgctaggccccaaaacattttcaatcacccaaaggagaccatgtacccattaaacagtcactcctcattcctgcctccccccagttcctggcaaccgtcagtcttctttctgtctctatgggtttatctatactggagacttcatataaacagtatcatacaatatatgaccttttgtgtctaacttctttcaattagcctaatgtttttgaggttcttccacgttgtggcatgcatcagtacttcatttttttttaatttttaattttaatttttttgagatggagtctcactctgtcgcccaggctggagtgcagtgggatgatctcagctcactgcaacctccatctcccgggttcaagtgattctcctgcctcagcctcccgagtagctgggattacaggcatgtgccaccacgtctagctaatttttgtatttttagtagagacggggtttcaccatgttggccaggctggtctcgaactcctgacctcgggtgatcacctgccctgacctcccaaagtactgggattacgggcgtgagccactgcgccccaccagtacttcatttttaaaaaatgatcaaatactgttgtatggctagatcacattttgcatatctattcatcgactgatggacagttgggttgtttccaccttttggctactgtgactagtgctgctatggtaattggtatacaagggcttgtttcgtgtgtgtgtgtgtgtgtgtgtgtgtgtatgtgtgtgtatatatatatatatttttttttttttttttttgagagactgtctcgctctgtcacccaggctggagtgcagtggcatgatctcggctcactgcaacctctgcctcccgggttcaagcgattcctgtgcctcagcctcctgaatagctgggattacagacgtgcgacaccatgcccagctaatttttgtatttttggtagaggactgggtttcaccatgttggccaggctggtctcaagcttctggccacaagtgatccgcccacctcagcctcccaaaatgctgggattacaggtatgggccaccgctcctggccttgtgtgggtattcttgagtgaaaaatacaagatgcagaaaaggatgcccaatgtgattctgatttgtaaaaggaatgacagataaagaaaccctttgtccgggcagacagtctgtatgggattttcattcttacagaaaaataggtaagaatccattctcaatggtcaccaagggaaaaaaagaaggcttttgcagaaaagtaaaaatgaaaaaccacaacagtgcacacacagtggctccatgcgggcatgtgagacacactagactgagtgattgtatgtgcagatgtgaaaaaaacagcaaacaacaaaatcagccccgaaactagtctctctaggaggggctgggcaggagcctggtcagatggagaaactgaagttgggaagaggggagggaactcctaggagagagtgatctccaaaaactgctccccacccctcctttttaactccctccccaaataccaggtcccattggagccaaatttcctcagtgttttggaatctcagacccgcaggcaggagacagattcttccccatggaggatgcggttgggtttttaagctcctgtagattgagcacttactacctgctaagtgtttcacctaccttatggcctgagtcctctcccagcccctgaggaaaagctattgttcccttatttatttattgttattgttactttttatttatttacttattttttagatggagtcccgctctgttgcccatgctggagtgcagtgtcgcgatctgggttcgctgcaacctccgcctcccaggttcaagtgattctcctgcctcagcctcctgagtagctacgattacaggtgcccaccaccacgcctggctaattttgtctttttagcagagacagcgtttcaccatgttggtcaggctggtctcaaactcctgacctcaagtgatcttcccacctcggcctcccaaagtgctgggattacaggcgtgagctgccgtgctcagctgctcccccatttttttcgttcaggaaagcaaagttcagagaggagtaggtttctgtgcagggcgtgtggcagagctggacttgaactcagggcggaatccttagccatggtgccccctgccacatggttcggctttccttcatctctgctccccaagatgcctggctccagctgaagatccagggttcccaggttcctcttctggggacaggtcctccttcagcctgacctgagctctgccacttccaccggcatgaactgtagcaacaatttggctacccgggcctcattctctccatctggaaaatgggcacagcatgtgcctttctgcacagtgaggtcatgaaggattgatgaggcaacacgcaaggagcgtaagcctagggcctggcacccaggaggccaccccagtgggccctgctgggtttccgatttcccctgtgacacctcctgggggccggatccccagcgggaggagggatgaggcctggggggcctggctctggcacaatgcagagcattgagctcatgccagccttggctttgggtttggacaaatacagtaatctgggcaggactcacacaaagacctgggggccaggtcaggcgaggggcgtcaggttacccctgtgggctgcagccacacaggcggcttggggggtgtattttttttccctaaagattatcattaaatgagccctcaccgaggcctcagcaggcaggtttcattacaggaaaaactgaggtataggggtttgcaggcctaacgggacacgctgtcactgtgataggaacagcattagcaataataacagctgtccttccggactggttcccaagggctaggccctaggtgaataataagccttttctcgatcctttctgcagcccgagaggaaagccccatgctatccccatttcatagatgggaaaactgaggcttgaggacactttgcggcctccaagggctgttctcttcattcctccagcagagtggatatgagacggtgcagggtctggaatgtctgggcagaaggaagagctggagcaaaggcctggaggctggagagcgctgtcggggggcaagtggggcagtgtcccactgcggggtttcatctcagctctgccatgtcttggctacgtgacctctgacaccctactgggcctctttgatcccagactcacctgtagaatgggtgtgtgagaagaaaaccttctggagcggggtgttgaggagagaacagtgcctgacacatcataataataatgctgaatagatgttattttcattcctaaccacttcctccaggaagcccatcctgacctctagctcccaaagtcacctggacttcctccatcacagaccttgccacagtgtgagaaactgcctcatccacacaccagcttctcacctccacccagaccctctgattgggactcccctgaagactgtgtccccagagcccagaaagagtccagcacagagcagctgagggggcaggtgctggtgaacagtgtcaatgagcccctgctactcaccaagcccttcacacacgggtccttcatttaatgtctttcttctcctagatagaaccttggctttgccaagaccggtatagttgctgctcaagaaatatgtgaggaaattgttgagatgaaccagcactcaggggaagggaggctttctgaggctggggccttagcaggtggagctcctgggataataataataagaaagatgcctggacgcggtgactcacacctggaatcccagcaatttgggaggctaaggcaggcagatcacttcaggccaggagttcaagaccagcctggtcaacatggtgaaacctggtctctactaaaaatacaaaaaattagctgggcctggtggtgtgagcctatagtcctagcttctcgggaggctgaggctggagggtcaatgattgaacctgggaggtggagcttgtagtgagccgagatcgcgccactgccactgcactccaggctgggcaacacagtgagactctgcctccaaaaagaaagacaacaataatcattagtctttactctgctccaggcaccaggctgagtcttctcagttcatctccccagcagattagttctattattgtttccatttcacagatgggaaaatcaaggcacagggaggggaggtggcttactccaggtcacacagttagtgagaggcagaggcaggatcaaagccaagcctgtttgactgaggagcccgccccgagaccttaaccacacaacccctccctagaaggaaggtgccactactggacacattttggagatggaaaccaaggctaagagagtcaggatggcctgcccatgtctggacacagaaactgaggttaagcaggagatgcccgaggcggggtccctgtctcctaggccagcaccctgaagaaggggtgggagacaaccccccaccccccaagctgtcccctgcttgttggagtttctggtcaataccctggcctctgttacccagcccagcacccaagacgctgcctcttccgcctgcctggagtctcgggtgccttcacaatcggattctctgtctctgcagctgctttccatttgagccctttgtgctgaaaataaaaaaaatgaaaagaaaacttggcaccacccctctgctttgcttcctggggaggaaggaggatcccagctacttctttccctcattctggggcccagagatacccacagcctgcccgaggtcacacagcagggttggagccgggaccctggccttagactccccttccagtgctctacccactctggccactgcctctgatgttcctggctcttcctctaggcccgtgaggagcagagaaattaggatgaatgttcccgagccctaccacatgctgggcactctgccatcctgggctcacgaaaccctcatgacagccctgtgaggtcccgtcatcccatttaaccaacaaggaagctgaggctcagagaggggaagcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccaggtaggaacaatgggttctcagagaccaaggtggcagggcggggcggctgctgagcaggggcggcagggcgaggtggcgggcggggcccaggagacttcatgctcccgcctcctactccagctccctgtttgggatctggggacgctccaagcacctcagcttctcaacctggacagacccacggctccagcaggaggcagggccagccctgtgtataaccataaatataatgggcaataatcagatttcacgcttaccgagccctactacaggccagacactgggtcaagggtccttcctgggtcatcacaatcagcctaggaggtgcaattaggattagtggctttttacagatgcggaaacagaggtccagggagctactcagcacctgctgtgccaggacaaagaactttgggaagtggggccctcagagggtgggtaccctgttcccagaggcaggaaagttgaggtggactggactcagtggggctcagtgggacaccgtggggagtcagtgctctctgggggcgagatgaattagagggagcccttttggttttttagaatctgaacatggggcgggggaagcagagatgtggggagcagatgaagcctccctggcactgctgggaggattaaaggacttgatggacacccagggcttggaaatgtacctggtagagagtaggtgctcagggaacaactcctgtttgcagaaacagcaactcacacttagggagcctgctgtgcatctgaaccccgtgcttgggtgtttctgacccccttccagctctcatccctcctctctccattttctcccctgtctcaggttcattcctatgtttcctcttgccccaattaggccatcttctatgactgcaacagtaaaaatattaattaaatcttataacatgaagtctaacgtggggccattccagtgttccagggcaggctccctgcgctctaggtaggcatctcttcacttctctttcttcatgggccccagtgcctgctgtggctcaagacatcacgtcccacatgatcacatcctaactaggaagagatgaacagaaaaggggactttctcctccaggatctcacttttttttttttttttttttttgagacagagtcttgctctgttgcccaggctggagtgcaatggcacgatctcggcttactgcaacctccgcctcctgggttcaagcgattctcctacctcagcctcccacatagctgggattacaggcgtgggccaccactcccagctaattttttgtatttttagtagagatgaattttcaccatgttggccaggctggtctcaaactcctgacttcaggtgatccacccacctcagcctcccaaaagtgctaggattacaggcgtgagccaccgtgcccagccaacaatttttcttacatgtcccagtggatgtcccctggtgtctcatggaatgatgggctcacatgtccacatttgaaccagaaaggaattcccgtggctgactcaggccaattagggttcagcctgtctggctgctccaaagagatgtgggctccgaaggtgatgggggcacggctgggctggccaccagctggagtctcactgacggcctaagtggcacagtgggcctgggtttgctcggccttctctggctggtcctcttggcagcgtctgccccctgggtaactgccccctccttgagcacagtcttccccagcctcttgatggcggcttgctggtctcgctggttctcctcttacttccctgcccgttcctccttgggccttgaaaacgacccctctcctgccttcatctgacccttgccccgtgagctcagctgtgcggggtccctcgtgcctttatgcgggctctgtcagtctgtccatgggtgtcccaggggcgcaccccactgggagacatggatgtctttcccagctgagaagacagcactgccacccacccagtgggccaggcctcagaccccagagttgtccttaactcctctctctctaaccccaacattcaatcctcagcaaattccatcggctctgcctgtggactgaatccagaactcgacaagtcttccctcctctgtctggtcattgctcgcctgcctgggcagaatctccgccctggactccccacccaccccacacagccctccacactcagccagagggctcctgttggaacccaagtcaggtcacaccattgcctcactccaaaccctactcctacctccctcagagagaaagacagtccctgctctggtcccaaggacagccctgcatggccttccccctccccacctcccctcccctcttccctgcccgcagtgacctccctcctcctgctagaacacatagagctttgccccacctctcctgggtgctctttttctggatctttccatgatcagccccatcccctcactcgggcctgtgcacctcagagaggcctcccagaccatccctgaaagtagccctgcccacccctaccacacctgccaaaggtcagcttcggcaagtggggactgtgtcttattcagcatggggccagcacagggcagtgcgcagaacgcagcagctggcgccgggctccgtgggtcctcccacagatgcagtccatagggatggtgtctgggtcccaaggtgacccctgggctgaggtcaccacctttcctcttccaggatcactgcctggatgacggtgggtgtcccagtggtggggagagcagctccgagcctccatcatgcccagagcaatgggcactggagcctggaaccttctttccgtatcacagaacctccaggagtctggaaggagacagttgcaaggaatggaatttaggaacttttggtccatgctcggtgttccctttgggggtatcttgtccgatggttattgtttttgtttccccttttcctgagctgtggtgcctattgttcaaacagaggaccccaagcgatggcctgcctcactcaggcgcaagcacccgagctgtctggcaaggtggcaatccaccacggccaacttccccttggggattccgcaggaaggacgtggcccctccaaccgaggcggatgtacggtctctccatagattccgcctgcgtaatcccatggccgcttcagctgggtctcatggggccaccctgtggcctgcgttcaaggaccacatcgtagcaacaggtctgcgttaaagctggaatcgcacccagcagactcggcctggggggatccaccagcccacatctcgctctcccgatacagccacctggcaattggctcttctctctccaaggctgtatttgttctttttgctgagtgtgtgcaggtgaattctcgttagttaaagcgcctgcgcggtggccgccctgaatacaaaaaagatcaaggggatgctgtcctggtaggtataaggagtgggggccccccacctttaccacttctccaggtgacccgagggtctgtccttagaataccaccaggctcagtggaacccagtttgaaagcccacgatcgaggtctgtccctttggtctccatctgggaaagtgaggcgagagatgagggagggggcattttgaggaccagaaatgtcgtggcagaaacagccagcctggagaagggagtctgggcagggcaggacccaaaggctcgagcaggatgtgtctggtgaggttgtctgggggaagtgacttgcctgtccccttcgttcattcttcaacattcattcattcattcattcattcaacacacaatgaagcacccactgagctgggggtgacaatgatccctgcctacaagaagctcccaggccggtgggggacatgaacacccttcaaaatgtcaatttgtggctgtgacaagtacaaggtgatctgagggtcagtaaagggggaaggaggttgatgtggttagggtgttcgggaaagcttcctagaagctgagctgggaactgaagggtgagtagaggccaggcagatgagaaagggaggaacgaatattccagcaagtggacacagcacatgcaagggccctgctgtgaaatggagcagagtaggagaggctaataggctcgcagctccacgtggcggacagttcgcagtgaggggcagatgtggagaggaaggtgaggtgggggctggacaggctcccagtgaaagcagcccagtctctatgccaaaggcagaggggttcttgggaggatctgagccagcagcaccagcttcttcctgaatactccagggcttggggccaggggtggtcatctggactcgatcctcagtgggataggagacagggtcacctggcacttccgcccacctctgccttcctggtctgggtataacaatcactgtctcttcgtctttcatgatttatctcactgaacccccacccacagaccaacacctgcaggtgccaggggttgaacccacttgtcagatggggaaactgagtctgtgagatgttctcatggccccacccacttccttctgctcagagaaaagaggaacggggaactgatgcccctggtcagctgggaagagtctgggcagggaatggggagggtggggccctcgggggcctgcattcgggatgggcaggggccctgcttccgtttaaccacagccctgtgacatgccccaaaagggaagcagcagccgcctgtcctcacccctccgtgccctagggagggggctggggatgcccaggggtggggagcaggagtctggggaggcctcaccctcccaccccaggcctcgagtctgggttcttacagaactctggggtcagctgaacccagctggtgacctccatcaagtcccaagaagaccttggcttcctattctgtaaatggaggatcagtctctctggaatgttctcagattagcacacagtgggtcctcactgaatggctagccagcagttgttggttgaataagctaaaagtgtttttctccctgaaaggagtagccaattagataaggaacccatgtatatgacattccacaaatatttattgagcacctattagatttcaggcattgtcctggtactgtggagcaatgaacaaacaagacaaaaatgcccccgtcacctttggagcccacatctctttggagctgccctgcctttcctggtttgtggcagacatcactaattgatcatctttcctgctgcaaccagaattctctccaacaccgtgcaccactcagagactgacatatggtggggaacagcctgtcatccccagggagggatggcacgtggggacttggaaggtctcagtgagaatcttctagctgatttaagcagcttcctctcagtctctttcaacaaatatttattgagcacctactttgtgtccagtactgtgccaggcattggggatacagcagtgaccagggtggacattacccttaccctcgtggagctgatgttctggtgagaaagacaagtaaacaaataagcagacacttccagacacagatactacaaacacatgccagaggcatatggtggagggtgacagggaaggagtctggggtaggttggggttgggggttctggagggagggtatttattgagacctcactgagatgcagccaccaaaggaaaatatgggggaaggtgtcacaggcagcacagcaaaggcataggcccggagtggggaatgaggttgatagatttaagggacaggaaggaaatagtgttgctggcggggcatgaatgtaggggagagaagcaggagagggtggtggagaccaggctggggccatacatccagggctcggggccaggggtgggctctgaatcacatctccaatgggatgggcagtcactggagggtcaaagcagggaagagacttgggcgggatcccatttcagatccctctggctgtgtgaagcagggacacccagccggagatggccgcagatgtccaggcgagcgaggatggcaacttggacgggggcgatgccagtgaatgtggggagagatggccaggcctggcgggaggcccagggctctgcattcagtttcatttttccttttacacaatcccccccggccccgggcactctgggtcactggactttccctggcactgccggtggggcccacaacctgctggcaatctggcctctccgagtcccagctggttccctgccctgtcctggacccttcctctccaggaacaggcccagctccagttcctctgtcactgtttcccaccacctcctgccccaggtctgcctgggccctgctgatctcctaattctgcctctgctccagcaccccctgctccagccctgctggctgcctgggagccggcagatgcttcctctgagctgccttttccagatcaagtttgcatccaaggaagcgagcctgagactcccagccagctgggggagacaagttcgagggaagtaccccaaggtagcttgccagagggcagcctcgctcttgggcagatttttcctctggtccagtttgttgttggatggagcaggcagatctaccttccccactgactcaggccttgggtgctcggatggagactgtggccgaagagctgtgttgagcagggctctgaggctgcatctatgatactaggaaggagactcattattgattagtgatgcctgctgtggacccaggatggaggataggggccacgctggcctcataggtgtgtctgcggcacccagtaggtcctcaggtctgcactcccctgttgtacctctaaatcttcaagtataacaaatgctgtttgaaaataccttatgatggtgggccgaggtgggaggatcgcttgaggccgggagttccagaccaggctgggcaacagagtgagaacccatctctagaggggaaaaaaaaagaactagctgagtgtagtggtgcacgcctgtagtcccagttacttgagaggctgaggtgggagaattgcttgagcccaggagattgaggctgaagtgggctatgactgtgccactccactccagcctgggcaacagggcaagaccccccatctgtcttaaaaaaaaaaaaaggagaaaaagagagagagaaaataccccatggccttggtttccttatctgtgaaatggggatgatgatgacaagcccccagagggcttccccgcaccctggcagtgactgacacagaggccctgagagctgcgtgttccagagtcatgcagctggtacatggccgagctggtggggtttgaaccctgggtgcctgagtcagggagaacaggcggaacagttgggccagggaggggaaggtgctgcccagagctcccagtgaccttggaccccacttctcctttctgcccagtgtgctcggcacacaggaagcctggcggggcctcccttgcccatcctgtctgcagccgggtggacacggggtcccggcgtcacccaccgccacccaggcctcctccttcctgtgttgtgcaagacgaggcgtcccctgtgtggaatgggcaggcagctctggcgatgggtggacgggtgaatgggggcctctcaggcggggtcactgcccgcggttacctctagcaggcctggcctaagcctccgccccttcctcctccttctcctcctcctctgtttccccaaagttcaggcagccttaagcaagaggctgtgggacccaggaaactggggaggttgtccagccaccatcttgtccccacagagcagacctaggcttgcgcagtcttggagaggtcctaaacaacaacaacaacaaaactataataataatgataatagctgttatagtggagtggcttctatgcaccaggcatgctctcatttaaccacaaatacataaaacgcacctcctatgtgccacgtgtgattctcagacctttacctcatgtcccatcgaatccccggcaacccttgtgaaacagttttttttttgtttttttttaatgattcctttcttcagagtagaaaactgaggctctgagagatgaagctacttgccaaggtcacgcagcacagtcacatcctactgaacatcatcctgttctctggggtgagtgctgtcctggaagttggggggctcagaagctgttggtgcccacctgggaggtcgcccttgcagctgctatcctgaatctcttgcccaagggcttcctctggccacaagagtgtgggaagcaagtgagagacccctgccagtagaggtggggtctgtttgtccccccactcagcttccttgcttctggctcaggggacagtgggaaggtactttctgcgagttgtcccagaggcctctagggggttgggctcctgttgcccactgaggagacctgctcatctaccttccttgtgtcacttcctcactccttcccagtgtttctagaatcacctcccaaatatcccacttgcacccaaaaccttgtcttgggtcagcttctgggagccgacctaagccagcagctataatgctcagggcttaagagctttggaatcagatggacctgagtgtgaatcccgcccctgccacttaacctgagtgtgaacttgggagcctgccccacctctcggaacctcagttcctccatctatgaaaagggaacttacgtgcagaaaaccaagtgactatgagggggatggggcagtgtgagatgacgggaccagagcacgttcctggctgcagaggccacaagtcacgctgtctctgagaggtatggggacaggggcgcagaggaagaatgatcgcgagtcctcagccctgtttggctgacgggggacagggatgggtgggaaagaggtacagcgtttttccaccttccccacccatcacccctgagattccaaatgaacatcgggaccaaccccgggagcccagcggatgttcagggtagggcaaagaacaggtgccaagtttgctccctggggtgtgagactgggcagcctcaagagctgcattggtaggactttcaccaggtagacagcaggcacctcgcccctgcagatcacagcttccagggccacctgtccacagaatcccttcactgatctgtgcttgaggcaggggtgtgtggactgggagtccttcttttactctgggtggggcctcatgctcagagggagctctgtctacccccaccacaaacctgcagtttccctgctacagcgatggcaacctcagccacctggctgcccaggcccccaacctgggttctccctcttgttcccatggtcagcccatcagcaaactcatccacatgtccaagggtccacccccactaccctgccctgccctggtccagctaggatgtttgcagtcgtctcctcattggtctccctgcctcctctctcgccttcctaagccagaggaattctgtaagagctcaagttagatcctatcccttctctgctcagaaccctctatggctcccaactcactcagagcagaagcccacagggcctgcaggatctctgccctggccccgcctgacctcactgcctctcccttctctgttcacccacagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacacccagcccccagcacagcgcctgtccaggacaagtgcccagtaaacacttgggaagcaatgcaagcgtgcgtgcatggataagtatttctttggcagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtcaccaccctctctgctccagggcctgtaattaccacttaccctggtcaatgggtccgagagattacccttgtaggcagggctgtggccagggtgctcacctggcccccagcaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaatgaatagtgacctctccggggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagaggtcagcatctgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggcttgggtcctggagttggggcccacgaggggattgacatctggggttgagctgggaatctgaagccagaccctgcagccagggacagcattccagtctcggctccacactccagggatagccttggaacgccaggcagttcagagagcctgaggtctggtcttggagacctgggttccaatcccagctttgccacattccagccatgtggccttgggcccttagcctttgttcctgtaaaatgggaccactgagagcccgatctcagggttttatgaggaggaacgatgagagggctgtgctgggcttcctgaagccctgtgtggcctggaaagcactcaatagatgataactcagtgtaatgatttcttctagcagatggggaaagcgagagttaaagaggcccgatcatttcactcactcattcctcaaacgttattaagcacctgctatgcaccaggtgctttgttttgtatccattaactcagggttcagcaaactacagcctccaggccaaatctggttcacagcctgtttttataaataaagttttattggcacacagtatgcccattcatttacatattgtccacagctgcctttaccctacaactgcaatgttgagcagttgtgagagagaccttaaaacccacaaagctgaacatatgaactctctggacatttacagtaaagtttgctaatccctggattagcccattacaaccctggaggaaggacatgtcataagcttgattttatggattaggaactgaggtccgagcgcagtgtctgccacaaggttgggtctccatacgtaatatctgggtcttattcctcctcttctgccccatggggagctgccaactcctgttccctttccctatcctgcatggatcataagtggataatttgaatcccgcagaggaaggaatgctgtttgaaggtcaggtcaatggaaagagtcctattttcaggtcaatttggaccttgccaaagcctcttccttctggtgaccttagctgagaggtctgccactagcaggtgcttcatgaacagttgctgaacaagtggtgtgcatcatgctcccgctgtgaacttcagcttgcttgaaggcggattcctccaggtaattgcaggagaccccacggccggccacacaccaccgttgggatgaaagatggcctcgagccatcggtgggagaacaccctgggcagggagatgctttctagagctccacggaagtgggggaggggatctcactgcccgccaagcatgccctggagtctttgtcccttcctccctcatgctggaggcctgcaggtacctggcttgagacgttgcctggccctcaaaacacccaggttccccccaagctcctccccagcctcctccctgctgaccttggggagctcccggtttgccctcagcccttttctggaggccccagaatcaccaagaggtaatcctgcctgctgcctggaggaggcgatgtgggagactcaggaacctggggtgtcccccagccagggggcgggcgttgtgatccggcgctgctgagcactgcagtgccttccctgatggccttgtgtgccgctccctgaccctcccgtagagcagccttcccatactgctgggtgacacttgcgtaaatcatttcacctcttggctctgtaaaacgggactggggtggtccctaccccttcagggtgtcgtgagaatgaaaggcatcaagtgggcaaagcgcttggcatggccctgaaccatggtgggcatttgtcacacacgctcatggacttattcctgggtccctaggataccctggagctcctccccaggttggacctgctgctagcatgagagggaagaagggggacacagacaccaaagacagttctcgtcctcatctaaatgctggcgacttccaagggcacctccccaaggcctcccctgagcctagactcaggggtctccacccacctgtctctgtccctgctgggatgaccaggagaagcctcaaacccaggttggccaggactccattcctgatctgccccccgaagccagtcctgcctctactgatggctcctgcatcctccaggtggtcccccaaacctgggagtctcccctgccttcttcttctcacttgctcccacatctgatcgctcatcacatcctgtcgactccaccttcaaggtagacccggagtctgccctcgtctccccacctccacggcccccgcttcggccacggccaccagcaccaccgcctggactggtgcagtcacttcctcctggcttccttttctccctcagcccctcacagtctgttctccacacacgaccagagggacctgtcagaagggacctataccttccagcacagaccctcccagggatcccagctctctgagtgaaagctccctgtggcccgtgaggccgggtgcgaccctggccccccagcaaaccctccacttgtctgatgacctcgctgcctctctccctcgcgtactcccttccagccctgatagcttcctgctgttcctcaagaagccctgggtctttccacctcaaggtctttgcaggtccctggagcccttgtccaccatggatgtccacggctccctcacctccttcaggtctgagctcggatgccactctcgacagccaccttctctgacccttcccctggcttaagtagcctctgcctgctcgacaatctctccctctacgcccctgaccatcccgtgttcttttttcatagggggaggggaaaggcactcccaggagagtggacagtgtgggccagggcctggacgtgtgggcagcaagagggtgggtgaggggagagtggtggagcctgggtggctgagcttcagggggaggcatcctccaggcaggagtgagcaggccagggtcaccctgactccgtcagccactggttgtgtgacttcagggagctctctctggacccaagaacctgcaactgctgttggagacccactaagtggacctgtcatctgacagagggggaaactgagtctccaaagctgctgctgtgacctgctgaaagggtcagcccagggatagggacaaaccaggggcttctagcagtcacttgcacctcagtgtgagtgagctccctggattcttggctgtctggtagcccctagaccccatggggcttgggaggcagagtgatggcagggctgagcctggggtggagtcagggctgtgtcaagtcccggcccagcctctgtcccggcccctggctccctgcagggtgctggattgcacaatcataccacccacagctgtgaccaaggcaggtgacacacgctttctgggagccacccttgggccgtgcagcctcgtcacacacacagggccaccgatggcatggatgcaccccggcacatcctgactgcgaggagtgactgctcctcacactgccacttccgggctgtgtgactctgggcaagtcacttcccctctctgagcctcttttcctcttctgtaagaggaggtaatatagtgcctgctcccctggctgttggagggattgactctgcccccgccatgctggccctctggctggtcctcaaatgcaccgggcatgccccacccagggcctccacctgcgcccttccctttgcttgggccggcccttgcacctccttcaagtctctgctcaaacgtcgcagctcatgaggcctttcctgcccctgacactccctccttactgaattcctccctgcatctctcagtgctacctgactcatcatggttcctgcttgttttgtctacccgctcctgggtggcagctccatctttgtctctcttggtcatcactgtgtccccagatcccaacaaagcacctcgtacaagaaagtgctcagtccatagttgcagaataaatgaatgaatgaatgaatgaatgaatgaatggaaagtgcttagctccacgcccgacccttagtaagcacctgaaacccaatgccgtgtggtggtgttagctttggctcccgatttctagccccatccaatcccaccctcatcagcccggcgcccgtgctttctctgcctggccagcttcctgctgcctgcacagtctcctccctgggtcaggacgacctctgagggaatcgtgggcctgcacggctggctccctctggctctgcctccagctcctcttacatctcccgggggcagaggcttctgggaaacaggctttgaagctcccctgggtcagacccgctggggccttccttaggcattgcctgatgtgaccccattagtgaacaaatggggacagtgagacctagagaggggcagccatgtccgatgtcaggcttcggggctcccaaaacatccagggaagcttccaggactctggcttctttgttgtttttggaacagagctgagctcaggtgcctgttttctagatgacaaaactgaaccccgttacaggctttggagccaggtttgaatctcagtcctcttacttcctggctgtgtgatcgaggtttgtcacttggtccctctgaggctcagcttccttgtctgcaaaatggcaccctaatggtacccaactcacggaggtgtttggggggacaaggtcagccatcctgcaggcaggtggggtctctggcctctcccacggggtcctgggactcctggctccggaacccccaaggcccagcccctccagggcccgcatggttccctccttgctgggataatttacagtcccagggccatagctgctgttgctttatttttttcccttccccgacttctcccttcctcaccctggcctcacttctccagaaccagcttgtttttgttttctgtttttacggctccataaatgagtcacgggtctgatttgatttaatttcgttgtaattgttatcttttcaagcttgtttttttccactcggttactcacgagaccacaaaaacctaaacaggacggggccttccccagcccggcctcctggtcccccgggactccgggccagggtcagcagctcctggagactgaggtggggtctgtggagcttctgtggggagggacttggtgtccccagcaggactgggtatcccgagtcccgggctgcagctctgttgctggacagccttgagagaattgttcgagctttctgatttccccagcatcctccttagcaggctttagaacagggaaccaaaacccaggcacctctgggccagaaggtgaaaggatgagtaaggtggcctggtgctggctccggtgaactggagagaacaggctctcctcaggggacggtggcctctgagccagcaggcggcccggatcttcccatttagtaagagaagccagaagtctgagattgtatgtgaaaagtcctgatttttaaatgttggccaacgagtcaaattaaaaacaaataaacaaaacctgactctgtggatatctgtggccccgtgggccacctctggtctagaaggttccaattctagctgcggcagccgtgttctcagtccttccacccttctgcctgagcagtcccctctgcctgaaactctctccttcttcctcctcatctcagtcactctcattctctgaacctcggtgtgtctcctgttcgcagctcagaagagatgacatctgcttcatccatgttcgccttcccaaggcgcctagttgttcccaattcacttttgtttctatgctttctcttccatggagggtctgtcttgtttgagaccgccttcgtagtgggggaaattagccccttagttgttaaaagtcataacacatatcctgcctgtcttatcattcatttctaaaatggggcacgatacttctttggtcatttaaaaaccgaagacgcgaggccgacgcctccagggatgtgcgctgggcggtaggagccaggtgtggggccaaggagtgggggcggaggaggaagccaggtccccagccagggggctgagggctgctcctccaaagcttgggtatggacatgtgaccagggcccaccaatcacatgcagccatgccagatttatgaatcagaagttggaaatgttgggggctgattgcttaggactccgttctggggtgggtggggctgcagcccggctatttttccagaagctgcagtgggccagttctgggggcagtgaccagggctcagcggtggccacagtgcagatggaatcattttgcagaaatgaccctccccgtgattatgtcaggaatgtcaagtacaatgaaaagaacactgcattgtgcagtcatgcaatttggtttaaatatgtttaaatgtatccacgcttgctttagtgtgttcattctaagaatctgtgtgcaccacagcaattatatgataattgtgttaggtcaaagagaaaatcaatttattttcacaatttttatcccccacgtggcaagacagtgacctagtcaaatctctctaaggtcattcttttttttttttttaagacagagtcttgctctgttgcccaggctggagtgcagtggcacaatctcggctcactgcaagctccgcctcacgggttcacgccattctcctgcctcagcctcccaagtagctggcactacaggcgcatgccgccacgccgggctaattttttttttgtatttttagtagagacggggtttcactgtgttagccaggatggtctcgatctcctgacctcgtgatctggctgcctcagcctcccaaagtgctgggattacaggcatgagccactgcgtccggccattctctaaggtcattcttcattatgatgctttggctctggttcttggtgaataactcactttacatggctttttcctgagccaaattgtccatctttattttctgagctgtggccggaggtctccagaagccccctcccagcgcctccctgggtgtgtctcatgctgcaaagggcatggcgatctgcaggctggtgctgcactcctggagtcctgatggctgtgaagccctgggacccatgcaagctgagctctgtcacccaccaccacctgtggcctcagccttcccaaactcctggctcagcccctgcctcaccttctctttcacctacttgtcatcccctctttaagcgaggccttgggtgagacccctgggcaatgctctgggcctcaaatggaagctccatggatgcttcagatgcttcagatcatggagtcctggaactactgaattttttcctccaggacgaaggaatcaccagccctcagcagactaaacctttgcaactctaaaattcaaatgcacaggagacctggtagaccaagtcatgtgcttgtttgggaagcatttattgagcatctagtatgtgctaaagtactagggagacagcaggaaacaaaatggactaaccctttgactttatggctcttaggttttgggagggggagacagcaaagaaatgacaaataagtgaaagacatagcatgtcccatagtgagaccactgggaaaaggggctgagtctgcaggaattgaaggggctggccacacagatgtctgggacagagcattccagatcgtaggaaaagcagatgcaaaggccctgaggttggaacaagcttgcattgtgggggaaagtgaaggagagccagagatcatccaggccctgagggcctcaggaggaggaggagtttgaattttattgcaagtgaggcgggagcattggagggctctgggcacaggagggagatggcctgactcaggttctaacaccaggttcctcagcttcggcaccattaacatttggggctggatgctgctctgtagtggggtcgtcttgtgcagtgtaggatgttaagcagcgtccccggcctctgcccactggagaggttgccagtcgcacctcctccccaaacccagctgtgacaactaaaattatttccagacattgcggaatgtgtcctgggtgcaggatctctctggctgcaaatggggcaagtggactgtggggggccaggatgttgtgatgagagcagagaacccagcagagatgactcccctagtctaggacaaaaggagggcgatggcagcagaggtgggagaagggactggattctgtttggaaggcaaagccagcaggatttgttggattgggcgagggagatgttggagtggataggtggatgcaggcgctatcgtttgctgagatggggaactggtttgaggggccaacttcataggtctagggcagggcccagaacctggcgtggtcacaacctggcctcagggggtgctgagtttttcacactgtgcttcaaagaatttaagtgtccagaggatgtacactggggaagggtctcttctaccggtgcagatgggaacaagtgggcaggcggcctttccttgccagcagaccaggagactctaagatgctttttcaagggagtcagaggatcagcctcattggaggactggttccaaaaggcagcctcacagccaggcgcgatagctcatgcctgtaatcccagcactctgggaggctgagatgggaggattgtgtgagcctaagagttagagactagcctgggcaacatggcgaaaccctgtctctaaaagaaaataaataaataataataaaaattagaataaaataaaagaagggattctgagactgaaaaaagccaaactcaggtgctgccagggctgggcaagcagcactcatggtgaagtggtgggagaggggtgcaggcctgtctaaaggggtggacgctgctcagtttctgccagtgtcgccccgtgggaagccgggactgacagtttttcatgagaagctgtaaatctagatcggggtgtccaaccttttggcttccctgggccacacataaaatacactaacactaacgatagctgatgagctaaaaagaaaaaatcgcaaacaaaatctcatgttttaagaaacattatgaatttgtgtggggccgtattcatagccatcctgggccacatgtggcctgttgttcgcgggttggacaagcttgatctagattgctatatgaaacctgttgatatttaaatgttagggcaaatatcaggccaggtttggcctgaaggccgtgagtttgaggcctctgtgatactgcagcccttctattttgcaggtaaggagctggcggggagagttagcacagctgcctccgagcctggcagatggtcctggatcggggctggacggggtgacttggagaggtggtgcttggactcaactgtgaagaagggtcagattcccacaaaaaagaggagagggcattgcagggggcggaggagtgtgagcgagcatgtgtggcgggaatatggaagactgttttccaggtggagggaggtaagaagacggggaactggaaaaagagttgaaggagacgggttgatgaggatgatggggaatacacggacacggaaggtcagactggacccaaaagagggttggaaaaatcacccaaacacttcaataatattagtaacttcacttctgaaattgtgtggcaacaagcagcgcgtttattttaccacttacttcgggttcttggcaaccctgcgtacaccagggaacgcttgcccaacaagaaacattctcactcgcagattgtttacaaacgcctcgaaaatttttgtaatatttttgtaaatattaaattagaaatttaatatagaattataaagtgtgagtgggttaattaaagattttaaaatttcaacttagcaggtttttctttttcttttttttgagacagggtcgcgcctagcaggctggagtgcagtggtacaatctcagctcactgcaacctccacatcccgggttcaagtgattctcccacatcggcctcctgagtagctgggactacaggcatgcaccaccacacctggctaagttttgtattttttgatagagacagggtttcaccatgttggccaggctggtctccaactcctgactgcaagtgatccacctgcctcggcctcccaaagtgctgggattacagtagtgagccaccacacctggccagcagatttctttaagtattttagaggcaatattttttccccaaaatctcccttgtgcaaattttctacctcacagctgccaaaatttgaggtggtggacaaaaatagttgatatataatgatagaaagacgtaagtgaggtatatatatagagagagtctagaaagagttcgctttcaaaggggaggatcagggcagtctccctggaggaggaggttttgaatacgtgcgttgaagggtgggtgaaatccagaccaggcaggtgggttagggaaagtgagggcatgccgggtgaagggccctgtgtgtgcacaagggtgaggtgggaatgatgagtgtgagagtttgtaccaagggggctggggctggggtgccaagaaccaaagagccatgataaggcctgtctggggctcagccaaactggggagtagtacacgagaagaggaatggggagccctagagggttttaagtaggggaggaacgtggagtccatagcaaggcagagtggctggtggggaggtggggaggatgccatggcaaccattcacgccaagcctcagccccgaccctcaaggaggcaggcaaggctgagcttccctttccagattgtttgtgggtgcaaaagggcagcaaagaatgtgggtgccttgtccttctgcccatggtctagtgtccttcccctcaccccagtcccagtggagccatcataggtgaaatataagaacaagtcacctgcgttcagtggctgcagaatacctggcctcgcacagaaggctgcggggatttctgctcattcattcttcccacctgccgcatgagggaggtgctatgtccattttacagaggacactgagtcccagagaggctaagcggcatgcccgaggttacacagccaagaaggggcacagcaagattcaacccaaaagtctgcactccagccactgccctatcatgacactcacgagctcccaccaagtctggctccagtgtttccagtaccataatcatccccatttaccagatgggtaaactgaggctctgagaggtggagtcacttgcctgaggccatacagcaggaagggtaaaagtaaagatttgaatccctgggtctagtcgactctggagcctgctgttctcccaccatacacctcagctgctcgccctcctgggcatctgtttcctcatctgatgaacaggggtgacggcgatgcctccctggcaaggtccgcagaggatcccgggtggtgtatgtcaatcacccagctcagtgcctggcactcagtggatgctttaaacgtgatgcctgtgtttattcgtataaaggtggctgaatattaaatgggtggatttatggaaggcacttatggtaatgccctgtacataatagatgctcaagaaacactagaagcagttactatgattataggatcgaccacaggggacagcccagtaacccctcaaagttgcttccttcccaagttgccttccatttatttctcccttcatccaacacactggccttagggtccaggttaggatttgggggcttggggggcttaggttacaatttgaggtgatttgtccccccctgcccatcagtcagagtgatgctgagagcactggatgataagaccagaattctaggtccgcgccccggacctgctgtgtgatctctggcaactgccttgccctctctgggccttggtttctcctttcatctgcagagcctgggccaggctgccctgggaggtgccagccccgaatggggccgggggcagttcctgtgtccccttggccaccagcctccatctcctgcctcttgagctgcaggcccgcccggctcagctgtgacgacgaaccagccaatctgtttactgaactggctgaccccttccgggaactcggcccaagcttcccagaactcgggtattaatgacccggagccacatgacggagcatgacacagcacttttgggcacaaggcagggcccagaggggtgcgtgggggccgcagcccagcccccaagccccgccagcgggtgagtcacctgggccccctgcagcttcctgatcccggccactcagctgtcctccccacccccaggatatccccagttgtcagggctgccctgggacccctcgacctttgcactagggacttagcagccgtcttgggtgatcagggctgccttctgggattacagatggggacagtgaggcctgcaggactggagtgaatgaacagtgagctctgagtaaacgtccactgtgcgggaggcactgtgcaaatacgtcacgttagtctcgcagcgatgcaacacagtggcgtagtttaatccccatatgatagatggggaaactgaggctcagagcgggaatgaattctcccaagggcatgcaacaagagcactctgtttgactggaaataatttcctttcgtctcctcagcagccgacaagggaggtgccatgtggactgtttcacagctggagaaactgaggcacagaggggctgagtcacctgcctaacgcactgagcagtctggctccaggacctgtgctctgaaccagcacctggcacatagctggcaccgacatggtctccgtgcactgccatggatgagagcaatgctggctgcggtgtcgggcggagctgggttccaatgctgacttcacctttctcaggctgcacagcctggagcacgtggctgcaccctaccgtgcgtcagtttcctcacctgtgaagggtgatcgtggtggtcctgatcttgcagaactgcagtgagggctgtgagtgtggggtgtctcaactgcacctggacacgcagaaggcactctgtgaacactgactttcattggcccaggcctctgaatccatgacagttcaatctctgaaccccacagcttcctccttcaccctttgccgccccagggcaaggtgagggcggtggtttttatgggcctgggaaccagacaggctcgggctcagagggggcgcctgctgctggcgggagtggggcctcctggttcccactccctgattttgggctgggggccggtggtgggcaggggtggggcagcactttgatgttcttcccttcattccaccaccactgcttgagcacctactgtatgccaggctccaggggacccagcagtgaacaaggtctctgccctcactatggtggaggagaggatggaggagataaacatcggtgagcaaatgcttgaagaggcgagaggatttcaccagagagaagggccgtgatgggaatcagcaggggtgtttgggagctgagtgggtcagagagggcttttctgaggcggtgatgtggagcagatgcctgaaggagaagaaggaccagacctggggaagagatttccagcagagggaaactcaccacagcacgtgcaaaggccctgagggtgggaatgggtttgggaagttccaggaaaggcaaggaggctgaaggggtgtgaggaggggacagcagcaggacatggtgctggagggccagcaggggttggaccatgcagggcttggtgggctgagtgagcagccgcggctgggacttgggcaggagcctatgtgagagatggcaagactgcctgagatcgcattcagaacttctacccatctcacagatgagctcagtgaggcccgagccagcttcccctagaaggtcagtggctggacaggcatgagaatcgagggagttcaactcccccggagaagccagaagccagaacacaggccgtggaggagagggtcccacattcatccctgcagccccgagagctgtgggctgtggggctgcctggatggcttcctggcggaggaggtgacctccaagctgtggctggggcagaagggctgggagagcgttcccagtaggggaagcagcacacagacaggcccagaggtggcggtgaggtgcaggcgttgtctgggaaattcatcactgcttgggagtcaggaaagtgaccgggtgaggaagtgttattgtcagggtctccctttcagaaggccttggggccaaggggaggagctggaattgccttccaccgcgtgcagaccccaggctggatcccaggactgcccagggacaggcacacgtctgccctcatgtggcccacagtccaggggcagggactgtctggagagattagggccatggggggcaggagggcggaggggcagacctcccatcctagttccaatctcagtgctgtgacacactccctgtgtgacttggggcaagtcactttacctctctgagcctctgtgtcctcatccataaataccacctggaaagatattctcagaactcagtgagatcattcgctcattcgtccactcatttattccttggattttttttagcgcttcctatatgccaggtcctgggctgggtgctggggacacagcagtgacaaaaatccctgcccttgtagggctgatggaagaggtagtgtaaagcagtgagtggttaagaacacagacattggagccaggggccttgggttaactcctggcccactgcttatttgctgtgtggttttgggtgagacactttacctctttgcatcctacctgtaagatgccacgtcataggattgctgaaaggacaaatgagttaatatatgtaatgtgtttagcacacagcctggtacatagtaggtgctcaattgtgcttgaatgagctgagatgtgcaataagcaaacagaagaggggtgagtggatgagacagtgtctgacagtgggaagtaaaagtgaccagctcttagcaacaagtaggcatacagtaggtgctcaataagtgtttctcctcctttgtctccttccgagtccatcttggaccttagcccataggggacttaagggcctgaggtttggaatctgcgtggaaggcgggaagtcgtctttgctgatccagaaacccagagctgagctttggggttggcaagagcagagacgcccccagcacccctgcccctcacgctccctgcaccctgtccccagcatcatgtgcagcctgggtggctgcggcgagctggggcctgcccaacgggtccccagtaatgacactcattacacaggtgtctggcagcggggggaagcgaaggccccaggggccgcattcacatggcacccagccagcccaccccaggcccttcctcgtcctttataagtctggtgcccagggcaggcgggcaggctggggagaggagctggcgaagggccagctggcgcccagtgaaaggagggaaagttgagaggtctgggtgccaagcactggtgtggaggccaggggaggtgggcacggggggcgcgtgtgtgtgcacacgtgtgtgtcagggtgttttggagggggcgggatgcagtgaatctgtgtccaggtctatgcatccccctggcctgtgtgtggagatgagagggtctgtgtagatgaagcattgatggtcccccaggtgggtgcaaaatctcccatgcccgtttcatttgttctttaacctacactgtgaggtgggtaccaggctgggtccagcctggacctggtgatgtcagagccagtcccagggcagccctagactctgccgtctaagagctccaaatccagggacagacagacgccaggcagaggatcaggacatcccagtgaagactttgatggagaaaaacaaggcagggggctgacagggatcaataggatggggtcagaggcctcactggaaggtgagcttggctggaggcctggaggacgagccgccatggcaagatctgcaggaagagagttctgggcaggaggaatggcaagtgcaaaggcctcgatgcagggctcagcttggcctgtgtgaaggggcgagtgaggaggggactgggggccggggcaggtccagagctcatggccaaagtcaggagtgtgcatcttctgagcgcagtgggaaggttggcacatggtaggtacacagatgggggctccactggggtgaatgggtttgatgagagccgggaccgggccctctgggtgtgggaacgattggctttcagagctacagacaggaacgtgggctgctcaattgtatttgaacctattctcctgggttcaaacccctcctggatcctggaacctgttattaagccggctgcaccccagggcaccggcctttatatccagacagggccctggcccccaagacgggggtggacgggtgatactggtgaaccccatgcctgccccaccccctgccaggcccctcggcagggccaagtctgcttctgagagcaatgagcatctctccttttacagatggggaaactgaagcccagagaaggaatgggtatgtcctgggttcttgtggcagagtgctgggggcagcacccagaaagcctccgtcacagctcatatctcttcctacttcatccccgcccacagcgggctcctcctaataggactctggcagggtagcagctggtgtccaggcagagctagagggaagagctgggtccaatttgagaagcctctgttaattgggtcctataggaagaactgttaacactgtgagtttcccatcaccagaggtgtgcaaatagacctggataacagcccttcacctgcttagagattacagagaggttcaggcggatgggagaccacttgccttctagctgtgtgattccacaggacctcggaacaatccttagctcaagcctcagttttcccgactgtaaaattgttttttgtaataatcagagtgacctcattaaaaggacaactttgttgataaaattctcctgcatttatccaggcctcgcttggttccccagtgctaagagacagctctagccctcaccatggcccgcacatcctgtagccctggtccctggggccttccctcccaccccctgattctccccttcctctctctgctgcaaccacagacttcctccctgttgttcctctcctacctcagggcgtttgcagatgctgtgagcattggatgtcgggcggagggctttccctaatttcaatctcccaccagtcctatcaggtaaataggagatccattttacagatgaggaaactgagtctcagagagctgaagttaaagacacacagctttttgtgaatccactgagtcaggatttgagctcaggccatctggaatctaacaccactctcttttcttcattccttatgtgacttgttttcattttcaaaactttgctcaacagttgccttctccaggaagccttccctgactaccctctccatccaccctcccatgaccttcctgagtttcacctttgctgcactgctcacactgtctctcaattatctccctttttttcttctcaacagctttactggggtgtaacaaacacacgataaactgcgcatattccagtgttcatgtggatgagtttggacatatgcacacacttccgaaaccaccagcacaatcaagacagcagacatatccatcgcccccaagggtgtccttgtgtctttttgtcattcatccctcccggccgccccatccacactcccatcgcctgccgactgtggctgatctgctttctgcggctgtggattagtttgcgttctctacaattttctgtaagtggaatcatgtggtgtattctttactgggcttcttttcctcaacattatgattttgagagttacccacgttcctgtgaccattctctttttttatgtatctgccctgtccccctcagactgtgagttccatggggcgaggactttgtcatatttacctctgcgtccccagcactcagcacagggctgggcacacaggaagtgcctaataagtgttgactgacgggaaggaggatgaggacatgcccaaatgggggaacagcgggcacatttgcatggcagtgaggagcccaaagccggattaagaaaaaacagcccctggaatcatctggaggcctcgtggccccatcagataagcatatctgctcatccccatggctgtctctgaggagcaaagatctggattgcacaagggctgggcctgggctgaggaggcgctagtggtccctttatcttgcgtgggcattcggcgctgtgttctagaactgcacagcccacgcaccccggcaggcagaggcctgggctccggcagcgggtgggcaggtgggaggcaggaagaagtggccacccagccctccccaaaccagttggactcctttgcagagattactgcaggcgctttgggagctggctaagggagagtgggaggcaggaggaaaaagcaggaggaggggaggaatcatttaatgagcaaatattatagggaatttccagttcatgccccatcaggctgggcaggaacacagtgggattactcaggcggtttccaggtaccagcctcaacctcgaaggttcagtgtggctcagatgcctctaggtcttcatcgctggctagaaacccaactagccagggtgagaaagtggcggtgagttacatcctgagacaaagcctgcaaccaaagtcgagtctaagcatgcgcttcctgcatcaatctttgctgagatgaccttattgcccatttcccagacagaaaaactgaggctgggagttgtggcattggctaaggccacacaggggtcactgcgcagtagggacagcttaaaagccaaggccattttggagtgactccttcaacaagggccacattcttttgataaatacttattgggcacctactgtgtgccacacactatgctcagctctgcaggttaaaaaaaaaaatggaggccggtcacggtggctgacgccggtaatcccagcactttgggaggccgaggagggcagatcacgaggtcaggagatcgagaccatcctggccaacatggtgaaaccccgtctctactaaaatacaaaaaattaactgggcatagtggcacgcacctgtagttccagatacttgggaggctgaggcaggagaatctcttgaccccgggaggcggaggttgcagtgagccgagatcgcaccactgcactccagcctgctgacagagcaagactccgtctgaagaaaaaaaacgtggagtctttgggcatatattgtgcattgcatcttatctacagatgaacacaatttttgaggtcagagatgttttgtggaactttgttttcttctttgtggaaacaagaagtttggaccagactagcatttcccaaatctattttatcatttatccattttgaggacacagatctgagggacacagagtctctgggggtactaataggagtgacaagggggaaagtgttccattagccattgggtttgggaattcctgggtgaacatttgccacaggtgttctcagtcttggatgctccaaagagctcaatgagcatctaggtggttaggtcctgtgagttaccctctgggatatctaagggagtttgttcactgtttttctgacttcatgagtcctgtttggatgctgcttcctccaaggagccttctctgaatccctagaaggacctgagtccccttctgtgaaggcacctgcctggagctccctttgacttctgaatattttccatcttgggttgtagctgtctgtttccatcacttgattgtgagcttctcaagggcagggccagccgtgattcacttcttggttctggtatagagaacagaatgggtggatggagcatttaatgggtgaaaagatgagtgatgacttgatggatgggtggatagtcaaatggataatttaatggctgggtacatgtgtggagataagggaactgtttatgaatggataaaatggatgaagaaatagatcaatgaaagaatagatgaatcaatgaatgagataattaacaattgaattaatggatgagtgaacacatgaatgaagaaattagtggataaatggagagatggatgatggatggttgaataaataaacaagtgctggattttaaattgtgtgatggatggagcgggtgatttcattgttgaatactgtgaattactgatggatgaatgaatagataaatatataattaaatgaatgaattaatacataaagtgatggatgacttaatagatggctagatgaataaacagataaagggataaatgggtagatggattggtgattccatgagtgaatgggtgggtgtatggatgggcaaatggttggatggatagatgaaagagtgggtggatggatgagtgagtggacagaagaatgggtaaatggatagatgaatggatgggtgggtgggtggataggagaatggataggtagataaatgaatggattggtgggtaggagggtggataatagaatagatggatgggtaggatggatggatggatggatggataggagaatggataggtagaaaaatgaatggattggtgggtgggagggtggataatagaatagatggatgggtaggtggatagatggatgggtaggtggatagatggatggatgagtgggtggacggataggcgaatggatgggtagataaatgaatagattggtgggtaggagggtggataagagaatagatggatggataggtggatggatggatggaaagatggatggatggttagattgattggtggatgaatagatgaatgggtggatgagtggatggggaaataggatggaggagtacatggatggtggatgagagaatgaatggatggataggtaagttggatggatatacaggtgaatgcatgctatgtcataagatcggaactgaggtcaggaggcaggaaaattcctgtgttcctccctgatgcagcagtatcaagtttttgaagtttgaaagcttagtgaaaactttgagtcaaatctccagaaaattgcatatagacacaaaatgttagcaactttatgggagtggtggtcatggagcctaagagccacctacagacccaaggtgaggaatcccagtgcagtcttatgtattatttttactctctgagccctgatcttggagaggaacccaggcccagtggagggaaggcagctgagatggggacaggtagtttcctaaaggagaagacacttatgtattcattcattcattgcacaacattgctgtgacctttctggatgcctgggagaagataaaggtgcctctcataagtggcaagtgtttggagcttgaagtcagacagattgcatttttaatctcatctctgatatgtactggctgggtgaccttgggaaacttacttcacctctatagaccttctcttcttcatgtataaatagggacagcaataatgcctaccctattgggttgtgaatatgtcaacaggtatgtaaaacatgtagcccagtgctcagtgcatagtaaatgctcaataaatgtcagttcttctttttcttcttgcatgactactgttgtcttgcactgggcctatgcaagatgctgctgagcccgagatatccaaggcatcatcctggccttttgaagtgtccgcagtccatcagggaacacagacaagtaagcagaggtttccattcgcacagggtgttggggctgagatagggaatcctaagacctcatgttcagggtcatctgatcctcagcatccattcctattaatatctctttctagcaagaggctgcagagactggaaggctacacgccgcattccccagccttctttgcagcaggggctctgaacgctctgcaggtcccgccaggcagatgccttcctgtgagagtcaggaagtgggggccgccttgttttttcctgggctctctttctgctggtgagcatggtcatgggatggattttcttgcagcaaccttggcgtccggttaccactcttggggagtctagaggtaggggtggtggtggtggcttcctcatctccagatggctggatggtgctgtgatacgttctcaaagtctacagctcctctgtggcctcctgattccccaccatcctgagtggctggcagctctcctgaaggtccagttctgctgtgtggtgctggtgcctctccagcccttctagcaatgttgtgagtgttcaattccctgtgttggatcctttctgcttaaaatgcctggaaggaatgctgtctctaaaatccaaaacaaacacaaaatttggaagggtttctggttgccataactgtagtttgactcacacatggtgggaggcggggagcactgtaggacctcagcaggtacctaaaccagacttagggggtcagagaaggtttacgaagctcatgacatgtaaactgaatcctgaagggcatatatggagtagtcagacaaagagttgagtgggaagaacacaccaggcagaaggaatagcccgtgcacggctgggcacagtggctcacacctgtaatcccagcactttgggaggccgaggcgggcagatcacctgaggtcacgagtttgagatcagcctggccaacatggtgaaaccccatctctactaaaaataaaaaaattagctgggctgtggtggtgcatgcctgtactcccagctattcgagaggttgaggcaggagaatctcttgaacccgggaggtggaggttgcagttagccaagatcgtgccattgcactccagcctgggcaacagagtgagacccaatctcaaaaaaaaaaaaaaaaaaaaaaggaacagcctatgcaaaggttcagagatcagaaaagacatcgtggagaagtgggtagttcgggctggctggaacatacaaattgtaagggagaggtcagaggctttaaggctggccaaggtgctacacttcctttgaaaataatggggagcttctgatagtaaacagcagaaaatagtaggtgtctttcaggctcctgcaggaggctgaatttgagggagaggaagtatcgttgcagggaaagtagcgaggtggcaaggaattgcagccacctgagtgagaggtgatgagattgacctggcatggcagcctcagaggaggggagggtggatggatttgagggaggttgaggacgagactcccaggctttggtgaccaattgggttggaggcatggcggcgggaggctttatggatgatgctcatgtttctggctttggacgctgaacagttgtgcagccttccaaaagaagggagacaggcagagggacagtttgggggaagttgctgaacttgctttgggcatactgatttggaggatgcctgggggccatccaggaggaggcatcggggaagtgtacagacatgtggtcagaggctgagacaacagattggatatggacaaccacccacgactttggagaaaatgagtgaaatattcattcaacaaatagcacaggggagcctgagacacactatctgttcatgtctgaatacctggcagtgggccaagggcctggctgcttgttcaataagccaggaggaagcgctggagcaagacttggagggtgggctgggttctaccaggaagagacaggatgagggcccagtggtcaagtgcgtgaggcctgggtttaagtccagctcctctgtgtgttgattgcaggggcctgggccagatgttttccctccctgagcctgtttcatctgaaaattggttataagggacatggtgaagcttcaaagttgtgcttgtggaagcaggtagcttggagcatggagcggacttttgggggacaacttgggacacagagagtcacccacttcctggtgtggcagagccacgggggatggggagagagaaattaggatccgcctgaaaaacatccacagctgtgtcccatgtgagaaaggagacctcggctcccgcccaggctccctttcaccccccagcctgctggagctggcgggcgggggaatcatctccatggagtggaggaggggaccagatgacagaaaacttctccacgtcccttggagctgctggagctgggtcctggccaccgtcccaacccatagctcctgactcggggtcaggctgagatttgctccttctctgcctgctccattcagctgcagcgaacagaggctgcaaactggaggcctcaggggcccaatctggcgcccaagcctgtggggctttcctcagcccacatagaatttttaaatgaatgaagccaatatttaagaatctgtgggtactacataaaaacctgtgttttgattccctctggaaaatcagggcacggagcatccgatcatattgggccctgttctctagggaccaccatcaaccggagctgagaggtgactgtcttcagacaaggcatgtgccccagtccccaccactccctcttgtctctctgatgctgaggccaaggaatagtagctatttatcatcttaccccagcccactctgctcattttaaattcctgcctggtccctggtgacacagttttcaaccccagagccagtctctttttcctctaaaaccacccagactttggccctggttctaggcctgaattggcttcccaagaaccccagtctctgagctcctcagggtcatggtttacctttccttctgccccacaaggcccagcaccacccccgggggacgatgacgggctgagacttggctggtgttggggggccggctgggcctgtgggaggcagacccacatgtgctctgagatgtgtcagctgggcctggtcacactctctgcggctcatccctgaggcatgtggaaccaggcgctgtgctcgtggcccagccagggtggtaggcggggccaggcccgggacatggtgtatgtcaaggccacgcacaacaggcctgatgttccagccgcaaacacattggttggaaagaggaaaggaggagggagaggcagagccgctttaaagacagtacccaaaatacagaggcagaaagagccgaactcacactgtaagttgctgtgtgaccttgggcacgtcacctcacctctctgagcctctagcttaagatagaactaaggacagaccccagcttgcagcctcgtgggcatatgcagtggtacagtggctgatgtggggcctaatgcctagaagggcagcctggaatggaggcaaaaatcacagactttggggccagatgaggttgccacttgtgagctgggtgaccctgggcaggtcgcttctccatctgcatccccagggaaggtcctcaccaagttattctgccaaaaaaagaatccattcaccgaacaaatatttattgggcaattcctgtgggtcaggcgctggggacatggcaggacataggacggtcaaaggtctctgcccccgtggagttcacacttgtggagagagcaggcaatacacaagataaataagttgcatattgcatttgagaagatccatgctagggagagaaatgaagcaggaaaaggagatgggatttcaatgggcggggcaggaacagcctggtgagcaggtgacagctgacaacgatctgtaggaggtgagggagggagccgcggggaggggagagtgttccaggcagtgggaacggtgcacaggccctgagtgggggctgtggctgttgtgtttggggtgtagcaaagaggccagtgtgtggaacagggtgagcgagggagagagactaggaggacgtgagggccaagaggccgtggggggcggatcctgcagggccacgtgggctgttaaaggactttggctttttctctgcaggacatgggagtcatggagggttctgagcatagaagggacgtggtctgacttcagttttcatggatccctctggctgcagtggagaatgggctggaggggccagggccaggacagaggcaggggggatagtggggaggtgatggcaatagtccaccctctgtttagtgatcctggtccttccccgctctaaagccttcctgacttcccatcgcctctggacaaagctcaaactccttagcgtgacattcaaggcccgcttacctgactctagctgctccctgccccggctcctcactctccacagcatcccaaccagatatccttccttccctgctccacatgcggtccacctttgcccgtgctgtttcctctgccaggaatgcccttcctgtccccctttgtgacccagttcatgtaaggctgagtcccacaagctaggagatagaaaaggaaggaatagaggaaaggctgttcctggggagggtcagggagggccaggtttcggctcccctcttcttcctggaattcatcctccatggcctccgcagctgagggcaggctcaggagctgggagtggggctgtagcccacacgaccatgctgtgtgaccttgggcaagtcacccaccctctctgggccttggcttttctgctctgtaaaatggggaggatcctggagctcctcatggtggttctgtgcacccaagggctgtggcaactgtgggaataatggcatcctggggaagacataactgcacttccttgcccagccacgacaggccagctcagggtggccctgagctgatgctaggggtagcttgcaggaggggtgccctctgaagccctgagcatctccagttcagtcacccctgagtgacctgagcacctacagtgtgtccagccccagcactgtgcttgagcacggacagaggccagacagcctggtttcaaatcccagctctgtcacttcctagctgtgtgatctgggcaagtaatgtaacccagctgggccttggtttctcacctgtgacatggggacagtaagagtgctctcctcctgggaagctcaaagaagccagtgtgctcctataaataccatgctcagtgcgtggaggaagcagcttatcaaggccaactagcattttttttattattattattattattattattatcaccactgtcatttcctggctttgtggcctcaggcatcacttgcttcactgtgcctcagttttctcctctgtgagatggggtaatagtcccaccttcgaagagttgccatgaggactgagcctgacgcatgtaaatgagcctggagcagagtaggtactctgtgatttttgtttgtttgtttgtttgagatagggtctcgctctgttgcccaggctggagtgtggtggcaagatcttggctcactgcaacctctgcctcccaggttcaagcgattctcccacctcagcctcccaggtagctgggactacaggcgtgcgccaccatgggcggctaatttttgtatttgtagtggagacggggtttcaccatgttggccaggctggtcttaaaactcctgacctcaagtgatctgcccgcctcggcctcccaaagtgctgggattacaggcgtgagccaccgcgcctggcctcagtctgtaatttcttaagaaaaacatttcaaatgcagaatttattttattcactaccataagtcatcactgatatatgaatagtccctatgaaatcctttgttattcctctagtcagacaaatgctcgtttggtttaatctgacttaacaaattaacgagatgaggaagaaaattccaggccttgggacattcactgaagcccaaccaggcaccaagagacacatgtccttctagtccttctaatgaagagtggaggaagatcaacacgatccttatttacacttcaagtcattatgactctgcagctgggtgaccttgggcaagtcccttcccttctcagaccctgagtctcttctttcctaaaataagtgtgatagcttcctacctgccctgtctagctcacaggattatggtctggctccaagacatcacggctatcatttattaagtccctcctgtatgcaaagtccctcttcctgaccaccctgcctccttccaggagggaactggatgctgcttgttttcaggacaggacagtgaggctggggaggtggcggaggatgctgcccagggagaggaggaagtagggggctggggctggctgggctgacgcagctgtgatgtcagacacccgccacaggcagccggcccagtgctaactgtgcgctctctgctggtctggcctggcgcctgccccctcctccccccgccaccccccttaaccccttcccggcctcctcttcccagacggccatcccccaggcccagccttgcccacaagattcccagatttcacaactggggctggcgctgaatcatgtacagtaagtccggggagagaaactcccggctgcctggcgtccccgggacaggacagctgccaagcctgccctccctcccaggggcccaccggcagccagggatcatcccctctgggcccctgaccagctagggggtgatgggcgagacacacaacctcccttggctgtgccagggatcaagggaccgtgtggtttccagggaaccttcaggctctggagggataggggcaggccagggtggtgggagaggggtcgaagtggccttgtattcaaccacggcctgccaccaaatcactggtgacctggagcagtccctaactgtaactctaagttacggtttccttatctggaaagtggggataatcacagccctgacctcacaggtggctggaaggactctgagaagatctgtgtacagtgcttaccgcaggaagcgcccaataaatattattattattgttgtgacgtcgagctggtcatgacacgctttaagaccctggagaaatcatccagttctttggaggacgtctcccctgaaacacccacccctcccgctgtgatacaaattacatcttatcttttcaaaacttcttcagtacatcagcaaacatttattgagcaccactgtgttccgtgcctgctaccaggtcctggagatacagcagtggacaaaacagaaagacatttaaaagccctctgttctcgtggagcctgtattctagctgaggagaatcagacatttgaggtcatttcagtaagtgagcagggctccaaaggaaataaagcagaaggtgcgatggagagagcctgggaggtcccctctgatggggtgacatttgaacagaagccccaacaaagaggagaagcccacgtgcaaaggcagggggtgggaaacggtgctccaggcagagggaaccgcaggtgctaaggccaggctgtgggatcctcttgttgaaggctcagcaagggcagtgtggctggagcagagggagtgagtgaggggcagaggggtgggaggtgagcttagtggggcccccaccctggagcagctctcctaatgccaggctcttcctgaaagtggccacctggtgcctgacttctacctgtaggggcagccacctgacaagggcccagcttcttcccatccggggtcccaaggccccggagctgcctgctcacagtagaaagcctcattcccaggaaccccacggagggccaggctccccgcccctgccctttgctcaggctgccgctgggactcccctgcccctcccggaggatgtgaccctccctgcctctcagccgctcagagtgtgggcatctgcatctcggagtctcagtgtgcccacctgtgagatgggcaccatgttgcctcagggagggagtaaaaggaggaagggagctctggccttagtatctgtcccctgaaccctggaagaaggaaaacatcggggctcactggggaccaggctgtgcgttcatagctggacggagagctcaggcgtgtgtatgtgcgtgtgtgcatgtgtgtgcatctgcgtgtgtgtgcatgtgtgtgtgtgcacgtatggggtgggggagacgggggtggcatcaagacccaggagccacaagagtgaggaagagggaaggggtgggcttccagggacagggggcagtcagagcctggttctggcgcccaagtggggattggggcagggggaataagaggcctgccctccctcctgggggcccagcggcagccagggatgatttcctgggatgttttaaaaatcatttatttctagaaaagtctttcatcatttcccttcaggtcacggaggctgagatggctgacggggtaggtggctgtggcctgatgtgtcacttttggcctcaaactgaggcaatggggacgaagtggctgcgaggcgcagtatctggcatatgtgtgagaaacaaccacagtgccctggggaggggccacgtcctcaccccgcaccgccagggtctcagcgtgtctcccaaaggtcatgtgggcctttaagaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggtaggtaaactgaggcagaacccattgcagcctgggagcctagcctgttgttcccctgtgactcagcagctcaatcaatctctgctttcttcccacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcaggtgagcaaggaccagcctccgccacgcagacaccctctttccggcttctctgtcctcctactttgccctgggtttgtggacttactctgggcagatctccacgaccaaccaccccctcccttggcatgtctgtcagcacccttgggggaaagaatttggaaaggggagggagaaaaagaaagcagggtgcgaggggctggttcccacacctgtgtaaataatttgtcatcttaaaatgctcaagtatgctcacctttaatgcctggttcttgggcttattttccttggcaaggcccccacgggagtggaatttcggccaaagggagcccagttgtcatcttctaaacatgttcccaggccgggggccggggagggctctggctgatgctccacttccgtccccagaagtgctggaacgttcctgggatctagggagctgactccagtcctggaagctgtcccagaattctggaatgttggaattcaaacggcctcctgcccattttccggaggaggaacataagacccagagaggggaaggggttggcctgaggtcatacaatgtgcagagacgagctagagtttgctgggagaaggtgcgggtgtgtggacaagtcagcatctatctcccattttcaggtaacagcacctcgacttcctactgaagaaccccctcttcccttttctcagtccatgaggctgggggtgcccagaggcctctgtctccaggggtggacatgtgaccgggtcttgctctagtgattggtccagggatgggcacatgactgagcctgcccaatgaaacttgatcttgggacttcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacacccctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaaacaggtttttatgtgaacataaatttttgtttatcttgggtaaatttctaggagtggaattgctgggccaggtggccaagtgtatgtttcactttatcagaaaccgctgagctgttttccaaggtgtctgtaccatttttcatccctaccagcaatgtatgaaagtgtcagttgcttcgtattctcaccagcacttggtggtgttagttttttgtgtgtgtacatgtgttttacttttagtcattcaaataggtgataatagtatctcattgtggtgttagtttgcatttccctaatgactaatgatgttgaacatctttgtatgtgtttctttgccatccgtatattttctttggtgtagtatctgttcaaactttatgtcagttaaaaaaaaagacccaattgttttcttcttaatagatttggagagttctttatatatattctggatactagtcaagcctttgtgaaatatgtgatttgcaaatattttctcctgttctgtggcttgtctttttattctttcaataggtagactttaataacatcgttttgttttctttttaagtatttttctggttatctttgatttgtggcatgtattctttggtttttcaattttagtgataacaccaaatgttttcttttaaaatgaatttatttaagtaaaaacgtcagtaaatttgaagaaacacattaaataaggaatagtagaagtggacagtagacagcataaaaatcgtgaaggcagtttccaatttgcataaccaaagtgtgggcagctccgattcgttcgtcaacaaatactgatggagcccccactgtccaccaggctctgagccaggtgctggggacacagcaccaagcgagatagttgtttgctcttttaatgctggtttttctccagtgagtctctcttcatctttcaaaagccaatttgaatgacccttccttcatccagaccttccctggaatgtttgtcacactctactgcaaatttctatttctgtatctcccaggcaaggggcatgtcgggcagcctctggtagggttgtagagagcttggtgcatagatatctcaataaatagcctctcacatagtacaagctatgatgaggtgctgaagaccagttgctgattcaattggttgaaactagccaggcctgatgaaggggcctgaggaccttccctgctgcagtctggctgaccccaagcaaaccaaagtctctccccttggcctcccctcccacataaagataccaagagaaaaagcctcccaaacccactgccttcagcctctgctatttgcttcccatccagtgcccatggatgcctttcctgcaagacacagtattcacacagacacttaccaggcatctttgttctgacctgccccaggaccaccactttcaccttggcctcttaccaccattcccctgttcctccactccagcacaccagccagtgtttgcccctccaacatgcccagctcattcccacccctgggcctttgcactagctcttccctagttctttgccttctctagctctccacattcagttctgaacttcactgaccctcctcagaggctctctaggctatgctaccaaagccctctctcctctttttttttttttttttttttttttttttgagacagggtcttactctgtcacctaggctggagtgcagtggtataatcatagctcactgcagcctccatctcccaggctcaagtgatcctcctgcctcagcctcctgaatagctgagactacaggtgtgtgccatcatgcccagctatatacatatatttttaaagtagggatatactcactcactgagctcagtatgtagctcaggctggtctcaaactcctgagctcaaacaatcctcccacctcggccctccaagtgctaggattacaggcgtgagccactgtgctcagacaccccatgtatttttgatcccttcattctgtttctgtcctttgtagcatggaatgctctcatttccgagtttatttgtgtgtttgtttgtttctcgccgtgtcccctgttggagtggcagttccatgagggatttgggtctgtccttctctctatctccccagtgcctagcacagtgttcagcacacagtcggtactcaatcagaatttgttgaatctatgagtgaatgaatgaatgagctcatgagctctcccttctccagatgcactcacggcaaagttgaacccatctatctgcccatgcgtcaggctagttgtcctgtgggcccctcctgggtgggtactgagggatgcccactgggtccagccaggcctgtgtcttgtcagctgcccaggctaagggactttccattgtccttggagttggcctgtggaaagttgttctcaggacctcgtgagcctggggccatggatggggctaaaggtaactgcaaggtatagggacccggcgtgaaattccatcagttaacactgtaagtgaggctttccagctccctttcgtcctccctgtgatgccaaggggagggagaaactccacgtggggcttgtgtgtcttgagcaccttcctaccacctgctttttcttcggaagaaacagagcagatcccaagtacaagccgtcatcggcaatagtagctggctttgtttcacttttttgtatatttcaccaattgtcttccatttgcagcaagtgccttagattgggtgcctgcaagcagaccttaacagaataaactgaaggcaagtagcctatttgggagatgcctccagaaagcactggtagggaagtgagatcagggaggaagggctgccaatctcaagagcgctaccaagccagtaaccacttaggcagctggggctcggtcctgctgtggcacgctgggagcccatgtagtaacggagttagccccccaggggcggagatcgggtggtcagggagctggggaagggacatgtcagctcctgcctatcattgcttgacagctgccgcttggagtgttagttcccagcacatccagcctgccccatgagcaaagctcacaggtgaaggggacaggtgctgcaggtggaatcctgtctgtgttcaccggagaaaagggagaggaggtatgggcagggcacagacaacaaaggcctcacagtcaacactggttcctcatttaaagccaggataaaatgagttcatttaaaattaagttttcgcaaacatttaaaaagcgaattgatggaaagagtaggtaatacctgcaggtgaaatgtgaacatggcaaatgctgctatttttcaaggcgtccaaagcctttaataggcaaacagtgttcttcacgacccacaagaatggcgtgtttggggcggtgaaaacactctccctttcctcccagcatgccaggctcatgctcactcctaacactgcccaggacccctgggagtcctggaaatgggccatgaggcttggaggcagaagccctgtgtgacttggggtttgtcccttaacatctctgggcctgtctgttaaaaggggatgttctcaagtcacataaaagagtaaatgtgcaaaaatagtcaaagcaatgctgaaagaagaactaagagagaggacttgtccgtccagacattagaatatatgacaaaggcatagaaataaaacagtttggtattggcatctaagtggacaaatacatcacgggaacagaatagcatccaggaattaacccggctatcacctggcctacctccactcatagatgtgaaaggatttagaaaagggaagagattggcaggcatgggattctctggattatgttatgtctgggctggtgaagaagcttccaacaggctccccatctgcagccctcccctctaacctaccagccatggcaccagggacactcactgtcatgagctgcactcacccccgctctgctctggaaatatcagagcctcccacgcaagatgggttagaccacagttgtcaccattcctccttttgcacttctctttgattcttctgattaacccaaggagaaagtctcaggcgggcgcggctggacttgaatacctctcccacgtttgctcgtctccctttatgaggcagagctggccttaagctcagggccttcagcaggcaggagaatggagcaagaatttggtaacgttcttttgtgattgttgttttaaggttactttctctttacagaaatgaaaagttgtttcctccttctgatagtaacacaaattttccttttaaaataattttttctaatccatattacaatgagaatgaacctccaaaacatgatgctaagtgaaaaaagccagacacagaggtctttttttttttttttttttttttttgagacaggttcttgctctgttgcccaggctggagtgcagtggtgtgatctcggctcattgcaacatctgcctcccaggctcaatgattctctcacctcagcctccccagtagctggtactacaggtgcgtgccaccacacctggctaatttttgtattttttgtagaggcagggtctccctattttgcacaggctggtctcaaactcctgggctgaagaaatccttccgcctcagtctcccaaagtgctgggactacaggcgtgggccaccatgcctggccagaaggtcacatattgtatgattccctttccaggaaatctccaaaataggtacatccattgagaccagtgaagaatggtggttgttaggggaatggggagcggctgctttatggtcacagggtctccttttggggtgatgaaaatgttttgtgattagctagaggtgatggttgcagaacacaatgcaaaaatgccaccgaaatgttcactttaaaatgcttaatatgatgctatgtgaacttcgtctcagtaagttatttttttaaaaaaccagtggagtaaaccaaaaaatcaatttacttaagaaaaggtatgaatggctttaaagatggcttttaagtgacgtgtgggagacagtggctaaggggatgattctcacccatcgtgagcctgggaccatggatggggccagaggtagctgcaaggtacagggacccggcgtgaaattccatcagttaacactgtaggtgaggctttccagctccctttcgtcctccctgtgatgccaaggggagggagaaactccacgtggggcttgtgtgtcttgaacacacattggcttataccttgctcaggcctggaaggccctctgctcactgacggaatcctatgcatccctgggaacccagctcaagcctcacctctacgggaagcccttcctgattacacaggtggtcaggcggggtcagtcctgcagcccttcagacccggttgtgaatcccagtcttgccacttactagtgggaggagtctcttaacttagacatattgtttgactaagagggcctcagtttccttatctggaaaatgggggcttatgatagctcttatctcactaggttgagctcctacatagaaagttttaggacagaacctggggagatgtagctgcccttcattcacacttcagtctgacactgatcacatcacagttgcattccttttcctcctgtctcctacactgtgggcaagggctcagcctttgtgatctctgtatcatgttgctgtacagaactcacacacagtaggcacccaagaagggcgggttggctgacgtgcagaggaactcccagaattccacctcttctctcacctccacggtccccaccctggtccagaccctgcatggcttacctggactattgtggtctcctcctccctggtttcctggcttctgtcctgaatcctccacctccaatccattccccacatgcagccagagagatcccgtgagaatctaagtcagatctcgtcccttctctgcctggaaacttcccacagctctcaccttgcttagaggaaaagccaaagtccttcccgtggctcatccactgtgggacatgccccaggtcctctctgctctctgttcctcctccccaaggcctcatccctacgacagtctccttgttgttgctccgacactccaggctccacctcagaacctcgcatctgccgttctggtttcctggagcacccattaccccacacggcccgctgctcacttcctcacctcctccaggcctctgctcaaatagcacctgctagggaagcttccccctgcttcccaggttttgctggactccaaagctcttttcttcccagaggcaaagcccttggctggggtcctgggcccagcccggtgactcaggcggagaagatgctcccaggcctcccgctggatttggggcccagggtcagccatgggggtaggcggtacctaggctgtacctggcgcagaggcctctgcctgcccctgccgtgggaggcagccctgccctgcacacacgggcttccaggctgcgggtgggaaagccccacatcctcctctgcttacctgactccagctgactcagacccccagccctggccagaggggagccgcagctgctccgccccttgatgggaagcagagctgtggctgtgagggcctggctgggccagacactgactcacctctctctatcccgcccctgcgctgggagccacgcctccctctggccagaacctcttggccttctgctgtgggagctgccccaggcggagtcttcccgaggggtgccttcttctgcctctgggggcctttctgttccttcaaggcccagtttgagggccatctcctgctaggaaacatcaaatgccctctggccagaaggggaaaaggatatgggagaggtaaaataatgataataataccagcaacagtaatgaaaacaactgttatacaagaataatagcagctagccatgctcactgtgtgccaggcactgtgctaaacacttcacattttaactcattcaatcctcacaatagtcctatgaggtaggaactctcatttcccaaggcacagagtggtcagtatccagcccaaggctaccagccagccagtgggaggaagggatgtgaatctaggcagctggacattgagtcgcattctcacccccagctctgagaaccgagtggaggcccccgaggctggaacgcagggagctgggagggaggggagccaggtcctgggctctgttccagtgcccgtccccacagtgggattttaagtctccccaggcagaggccagccccctctctccaggggaagaacctcccagagggagggccctgccgcagcacaggctggtgcttgttccctccattggagtggagctcagagcagagggtctgggcagtctaccaacattgcccagccccaagtgatgccagcccctgctctgggcagccaccaaacaggaattcacacaggtagggcagggaccatggcgtgggcacttaacccattcaccctgccagccacactgtgaagtggggacagtacaaacatccgttttacagaggaggagactaaggctcagggtggcaggacttgctcaaggccacagaggcagaacatggtaggagcgaattcaaacccaggattgttctgatgccacacggtcagagtcccttctactgggtggtgacacagcatctcagtgaagaacagggcagggtgggaaggagacgcaggaaaaagcctggagcctcagttcacatcaccctctccctctggccttccactaacctgaactcaccagtccatcttttcattcctttacccatacctccacctacctactcatccacacattcatccgccatccaaacatctctccatctgtccttccattattccatctatcctttccatccaactctcagccatccctccacccatcaagacttccctccacctgtccttctattcatccacccatccattcttctattcctcctgccttctatctattcaaccttccattcatccatctgtccatcagttcaaatatcatctatccacctctccttccttccaacctccaatccatccatccaaccgtccgcccacccattcatccatccactcatccacccacacatccatccatccattcatccgcccacccacccactcatcctcacatccatctacacatccattcatccatacagcccacaaatgtctatttgaatgacagctgtgatgcccaagccttggggttgccgtgccttgagccaggagaaacatgcctaattaggtttctgtttatttgttgttccaagaaggctaattgtgggctttgtaaacagccctttgatggctgaggagttactttaggaggacagttaaataaacaatcactgggtagaaaacagttagtgctggtacacggcgggtccggagtcatggcctgccttacagaggaggggtgagactgagttccagacagtgcagagctttgagtcagagtgatgggaatgctggcagtaacagctcatctgtgttgggtgcctactgtgtgccagatgctgtgccaaggggccctcacagcaactccaggtgatggcaaccattatggcaccaatttatgggtagggagactgaggctggggaagaggaagctgtgtgtccaggttcgcatgtctgagaagtagcacagccatgacactgatctagacctgtctctgtgcaataataatgataataataacaaataattacatggtacttactatgtgcccggcactgttctaagagccttctttacctgtaccctatgaggtcagaactaaacatcatccctgttttacagatgagaaaactgaggttggagacatgaagcaacttgctgagaatttgtaaaaattaattatctgggcctaaagtcttactcttgatcatgttattcagtggaatgcactttctatgcatttaactcagatccagccatacatgatctgccagacagttttaaaaaaataattgttcttgtactttatatctctaaaaatactacaaaattataacttatgtgttttttattacttgctgctgaggttggtaaaatgtttctgtaaagagccagataataaatgttttaggatttgtgggccagaccctctttattgcaactacttaactctgccgtggtgcaggaaaacagccacagactgtatgtcagtgaatgtctgtgacagtgtgccaataaaactttatttacaaaaacaggtggtgggtcaggttgggctcaaaggctgtagcttgccagcccctgactttgcagtacgcatgtatttgtatttaccaaaccatgttctctgcccttttatgaatgagataaaagcttttcaagcatgatttcaaccaggccatttcacctccaggccatttgctcaccacatgccctatacactgtttagcagtttgcccactattggcaattttggaaggaatttgcaaattacttgaattaacctgatttcttcatttgcaatatcagtaaattaatgacacctgtgaggggcactcaacttggccgtcaccccagcagggacactgaggttgcttcactccaaatctgtaaactttaagcttgataaaaaaaattgaaaagtgaaagtgaggagttctgtggctggggttctattactgttttctattggtgacaagaacaaggaaatgaaaggatgatatgggaggggtattacaaaatgtactcagggctagtgggaagagaacggagtagtgtcagaaagatcccttttccccgttatccccaccttcttcccatcagtgttcatttcccaacctcagaaaagttgtgagcctgggtaaaacagtatgtggccactccagagttaaaagacaaatggtaacctaggtaaaaatatttgaaacataaatgtagacaatgaatttatttccacaatatataaagagttcctgcagaacaataagaaaaaaaccacaaacccactagaataatgggtagtggatgtgaataggcaatttacataaaatacagatggcaaataaacatgaaagatgttcaaccatgctggtaatcaggcaaatgcaaattaaaacaacaatgcgagaacatttcccatgcctcaggttgacatgaatgagattggtgatgtaaagtgttaaggagactgggaaacggtcacaccgatatactgccggtggcagtgtaaattgaaacagcctctccggaagacaattttcacagtagccagtaaaactgtaagttcacatttttgggggaaacactgcagttccttgatgtggcatctcccttagtgaaacatccacacacaggcacagggagtatggtcaagatggtcactgggagcaacctaaatatccatcagttgaggaagggttaaacaccctgcagtggtctgaggctccccatcttttgaagcacagtctgcacacctccatcactgatgttgaacctgctaggtgctcactcttccaagcatcccttgcagctagggggtggtcacgtgacccaggtgccaccgatcagacgtgctcactgagacctggaagcagggatagttcaggggcagcagagagggcccaccgatccagtgttgtgtgtgatttggggtactgtccctgctgaccttaagcctggttctgcaatcctcccaggctcctcaaatcccttattttattttgaactttcactgaagtatagcacacatagagaaaaatgcataggtcgtaagcgataacttcatgagccttcataagtgagtacacttgtgtaaccagcccttcatcaagaaacagaatattccagttcccttaagcttcccttaatgccctcttccagtcacgacttccccgaggctaaccaaggcgagttgtgtctatttctagtgctttatataaatggaatcaaatgatgtgtgcttgtttgtgtctggcctctttcccttaatgttcaagtctttgagattcacccatgctgttgagtgtggttgcagatctttcattctcattgttaggcaaaattccatagttggagcagtgtctgagtgtgtctctgttctttcattcattcttctactgatggacatttgggtactttctagttaggggagatttatgaatagggctgctatgaatatttatatgtgtccttcttggtgaaaatctgtctgcactactattgagtgtagtcctctcattgggtcttatggcaagtgtatgtttcaccttattaagttgccagtgtcttctgaagtgcttgcaccattttgcatttctaccagtcatgtatgagggttttttctaaatgctccgtattttcatccactcttggtattttccatatttttcattttagccattctagtgggtgtacagtggttatctcatcaaagttttcatttgcatttccctgctgagcaaggatgttgatcacctctgtgtgtttattgatcctttgggtatccccttttgtgaaatgcctactcgagtcttggccatttttgtttattggattgattgttcttcccctcataaagtactttgaatagactgcttctctgtttaaattactgtatcagccagggctttccagagaaacaaaacctaacaggatgcgtgtgtgtatatctatttatatttaattcaatttttaaagggattgactcatgcaattgtagaagctggcaaatgtgaaatttgtagggcaagccggcagactggggactcaggcaagacttctatgatacacacttaaggcagaattccttctaccaaaaacttggattttgctctcaaggccttgaactgattgaatgaggcccacacacattatcgagcccatctacaaaatatcttttatttttatttgtatttatttatttatttttttgagatggagtctcactctgttgcccaggttggaatgcagtggtgcaatctcagctccctgtaacccccacttcccgggttcaagtgattctcatgcctcagcctcccgagtagctgggattacaggcgtcccccaccatgccgggctaattttttggtgtttttagtagagatggggtttcgccatgttggccaggctggtctcgacttcctgactcaagtgatctgccttccttgacctcccaaagtgttgagattacaggtgtgagccaccatgcgtggctcagaatatcttttttttttttttttttttttttgagacagagtcttgctgggttgcccaggttggaatgcagtggtgcaatctcagctcactgcaacctccgcccctcaggttcaagtgattctcctgcctcagcctcccaagtagctgggactacaggtgcctgccaccatgcctggcaaattttttttttgtatttttagtagagatggggtttcactatgttggccaggttggtctcgaactcctgacctcatgatccgcccgccttggcctctcaaagtgctgggattacaggtgtaagccaccagcccagcacagaatatctttatagcaacatctagactcatgtttgaccaaacaactggacactgtaacctggtcaagttgacacgtaaaatttaactaccacaattacccagagctgtttatgttgctctcaactcttagctctatctaatctactgtgaacatacatgcacactcacacacatgcacacactaccaacaacagtggtagacatttcattgtaagtgcacagaagtaaatatggaaggatgctaaactcattacatgacccccttggggaatgtccaggatggacatcaaaggggattttaactacaagctgtaactgtaaaaaatatttttaagaatataataatgggttaattgtataattaaaattaatatttaagtggcaaaacttttaaaagaaaaccaaaggagtcgttaagtccccattattcattcagcaaatatttactgagcacctactttgcaatagttgttggagacactggataagacagatccagtctctatcttggtggagctgacatcatagtcgagaagacaggcaataaagaagcaaacagggaaatagcagatgatttcagaaagtgttcaggagtattctgaaagcaagcaagccatgtgcaggggcacagtatgaatggggacagggttatgttggtgtgggaagtcagggaaggcctccctgcagtgatatttgagctgagccctgaaagaggagaaggagctggaagagcacactgaaagaggacaaggagctggaagagtggggaccaactcggtacatgcaaaggtcctgtattagtccattctcacactgctaataaagacatacccaagatttggtaatttacaaagaaaaagaactttaatggacttacagttccacttataggtctggggaggcctcacaatcatggcagaaggtgaaggaggagaaaaggcacgtcttacatggtggcaggcaagagatcattgcaggggaactgccctttataaaaccatcagctctcttgagacttattcactatcatgagaaccgaatgggaaagacccaaccccatgattcaattacctcccacggaatccctcccactacacatggggattatgggagctacaaatcaagatgagatatggatggggacacagccaaatcatatcaggtcctgaggcaggaatggaccagatgagctgggatgagaacccaagcaagcttctgacttggaaaccgaggctcagagagggatacacacaactcaaggccacagcactggacgtggtataactgaacgagaatccagctgtgtgctggtgcagagctgcctgtacaggaaggaggcctctgagctgctcaaagggctctatctgcactcccccacagaaatccccttatgatcagagccaaacattggagacccagcccccaggcttgtgccagccttgccctgccagccaaggccagtatccccactgaggggcatctgagggctctgtacactttgcctctgagttgaggatcaatagaagctaccactgctgttttacctaattatataacagtggccagggaggaaggtgtcagggatagacgctttaccggcaccatcccatcaaatcctgctaagaactccatgaaggggtattattattcccattttgcagttgggaacactgagactcagagagatcaaatgccttgacttcagaatctgtatttttttttttttttgagacagggtctggctctgttgcccaggctggagtgcagtgacatgatctcagctcactgcaatctctacctcctgggctcaagccatcctcccacctcagcctcctgagtagctgggattacagatacataccacctaaccaggctaatttttgctttttttttttttttttttttttgtggagagggtgtttctccatgttgcccaggctggtctcaaactcctgagctcaagagatctgcctgcctcagcctcccaaagtgctaggattataggcatgagctactgcgcctgcccagagcctgcattctttacctttacagtctagaccctgctcctatagatccccaggaaagagcaagaccatcttttttaaatgccagagcctcagataggaaaggatgatctcacccaggacttcattatacagataagaagaccaaggtccaaagaaggagaggaaccatcctctgactatacagagctgggtctcctgctcccagagcccctccagctttaccccctgctcccctccccttccttccattcatgatgacctcactggtctctaggctgtcgctccaacatgctgagctcaatcctgcctcagggcccttgtacttattcccctgccagatctagcctatcatttcttgtcttcattgaccactccatctatagtggctctgcgtgttgctttcctacctaggtttatttttattcctagcatttatcaccttctgtcattatattacgtatttatatagtttctttttgtccactacctgcctagaatattagaaccatgagagcagagactttgttcacagctgtatccccagtgcccaacccagggcctggcctccatgatgctcaatatgtgcttgtgggatggatagatgggtggatgaatggatggatgaataaatgggtggagaaatggatgtatgatatgagggaggaagggtgggatagatggatgaatggatgggtagattaatgagtggatggatagatggatggatgaatgaatggatggatggatggatggatggatggatggatagatggttggatggatgtttggatggaggggtgggtggatagatgagtggatggatggatggatggatggatggatggatggatggatggacagctgaatggacggatagatggttggatggatatttggatggacgggtgggtggatagatgggtgggtggatggatggagggaatgaggagtggatagatggatgaatggatgggtagatgggtgggtggatgaatggatcaagggagtgagagagggaagggatggatggatagatggatagaagggtatactaatgggtggatgaaagggttgacggatggaaggaatgatgggcggatgggtgggtgagtggatgggtagatgggtgggtggatagatggtgggcggatggacatttctcccagcgtcgcttcccatccctgtgctgtgggtctctcacgtggctgccctgacttgcctcccctggccccaagcccgagcagggagctctgggggcttccacatgattgggcaggatttctatttctcaccctcctctgaggctgggcagacaaaagcctttgttcttcctccctgcctggccctgctccagccagggtgggaagttgctggcaagtcagcaacttaactttgctgcaactgaactgaactttgaggcgtaacctgtcaagcgagccccggaggcttctgcggtccacaggggaggggcatgatggaggcatggtggggagcaccatggccaggcacagagatgatccctatctgggtggacccccaagtctcccagagtagattcattttttgaagcaaggaggggaagctaatagatgaagctggctctgggctctctgtggacagctggggacggtgtttctttttgtcctccagagttgttctgcagggtgaggggtaagaaagggggccgctactaagtgctcacggtggtcctgtgagggggtgtcacggtcaccattgcacagaggggaaaactgaggctcaaagagactaagtaacacgcccccaggatcacccggctagagtatggaaggcaaggtatggacctggacagtgtggctcagataaaaatttctcatgtcccatgtcaccccgtcacacttggcataagagccacagttcttccctaacactgccttgctggatgaactcaggtaagcctctttccctctccgggtcttagtttctctcctctgtaaaatgagaggcttggctgggccctaatttagatattgcaggattctctgggttactgggatcactgggttcaacttccataataatatgaagtctcaaagaaattctcaaattctctcacagtcctgtggccacacccgggacccacaggcccattagacagagcagcaaactaagaccctgactggcaccatcatttcctccagagccctagagtgtgatgggatcgctgtgtctccgcctgaaccctgtctggagttccaggtgtccgctttcccccaaggctgggcactgcacgggagagagagtcagagaaagcagaatcttgggcaggcgctgctgacccattgggtgggaggtctaagaatcaaggctgcaggatgggggatgaggtgggggggcccttttctctggagtgggaccctcccttggaagccaaactgaatggtcaaccattactctgctgggctgtcactaaccactcaaaaccagtggccacttgccaatcttctgtctttgtccagggcagaattgaatcttgttcaaataaactcaaaggccaggtagttcactgaagcaatgactggagaatttggcactctccagcctgccagccctacccaaacatcctcaaggtatctgcataaccagctcattgccctgcctactccaaccagagaatgtgggaagaagcccaggacctctgtgcggtggtggaggcccgcttggctgctcctgacctgtgtctctggcctcttcagcctttcctccaaattccactctgtgcacaagctgctggtcacctccctgcacatgctgtgtggcttctggcctcgggacctctgcacatgcagtctcctccactgagttctcccagaaacaggccctcagacacgaatttgagtgcaaggagtatattttgggtggtgatctcaggaagcacccatagcaggttgggtaatcaaaatagggaagaaagaaaataaaataaatgttattaaaccaatcaccgctgtgggcaactagacctcagacccaccagggaactctgggagacagcgaagagcatgcgcttcagtcattccaacccagttgcaagggaagagatcatgtatcttccgacttcccccagtcgtgagctgcgggctaattccaggggctagttccaactctctggaacttctagctgagcgtgcacccatggccaaatgaaagcacttaagcagacatctgcagtgagcgagagtgggcatctgtctaggggacgcgggccgggcagcaacagcatctgctacaaatgtttcctggttcctgaccttttgcaacctgactcctacctactcttcaaagcccatctcagatgtcaccccctcggggaagccttccctgaccctcctaaatcagtcaatcacttcatgagtttctaatatctgcatgaatcacagtggattgtaattgcctgtcccacaggggagtgaacaacttaaggtcaaaggttttacatcttgggcgttaagaacatgcatgtcacgcagtcttgagttctgctctcctggcccctctgaacaaactgtggtctcctatctgtccccagggcctggttgttattgggccctcagtgaacgtccagataaagggattggaatggcaatttcagctcattgacttttcctctttcccctgaactttcctggtatttccatgatggatgttgtggttcagctaatgggtcccgattctaaatcctcttcagaatcactaggatagcatttaaaaaactttgggggctggagccccatccccctgagattcagattccgttactgggatcactggcttcacctttcataataatatgaagtctcaaagaaattcccaaattctcaaccggacaagggcatgcagggagtgagtttgtcatgaagtcctacggggagagggccagagggcaggcagcctggagtccatgctgggagacaaatgtggaggaagcagaaattagaaattaaaagaaatgaactggacatatgggcagccacatggttagagcttaaaaacaaacatagaaaaaagggaacatggtggagcaatgttttattacaatacgatgtaaatggctgagaaccacaatgagactgtgccgtccttaggaaggggctgtcagactcagctgcccactagatttgcctggtaacccttaaagattcctatgcccatgcctacccccaaagccactgcagtggaatctctggggcgagatccagtatttttaaaatgcgaagtctgggctgagaactgcagaacacgggagaacagctatctcaattctttgtcctcagaggggaattcatcctgtaataatgttacaagggtaaatggaaaaccaactatatgccaggcactgtgctcagagctttgcacacattacctacccttgtggggagagttcttttataatccctacttcatagatggggaaactgaggcacagagtggtgaagtcggtgaccaaggactcacagctattcagtagcagagcaggcttgtcctcagtacccggggctgcaagtctggcaaaggagtccttggcacctccctcctgtgtgctccaaaattgctctctctgacgccctttgactcacttggttcagcaaccgcaaggagttgttgtttcccataaattcctcatggtctttttttttttttttttttaaacctcagcgcacaggcaaaccccacatcatgaaggctgatcggcttttgaaggcgagaccttcattctaaaggtcacagctgtatgagccgtgtttattagagcttattttaaattgctccctcaaccctgtgaaaggcgggaagtcttaaaattacttctccccaaaactggcgccacccaaccctggaagttctctgacttgtttcataaggaattattaattatgatttgtttttataattgtccacttggagtcttggatgacacacgctcagacttgcccatccttttttaaaagaaggaatcaaaagttcatggaaatcagttatatttaatgagtggaattacttgggctcagtcctggattaactgtgtgaccttgggcaaaccccttccctctctgagcctctgtttttctagctgtaggaggaagagtgtggattaatatctctcataggatttagaatatgtatttcctgccagtcgccatggctcacgcctgttatcccagcactttgggaggccgaggtgggaggatcatttgaggccaggagtttgagagaagcctggccaacatggggaaaccctgtctctactaaaaatgcaaaacttagccaggcgtgttggcgcatgcctgtaatcctagctacttgggaggctgaggcacaggaatcatttgaacctgggaggcaaaagtttcagtgaaccgagatcatgtcactacactccagcctgggcaacagagcaagaccttgtctcaaaaaacaaacaaacaaacaaaatatgtatatgtgtgtgtgtgtgtgtatatatatatatatacacacacacacacacacacacacacatatgtatatttcccagaccataaatatgccaggggtatatgaagaggttttaagttgtacatggatggacattttataagttgtattttttatttcaattcttaaaatttcatagtattacaacatttcatttgtaaatgcagacatttcttattgttaggatggtcaatgaggaggaggagctctgcttcatgcagtcagtcactcaggaatctgacagatgggggctcagtcatctgcaacaggtagcttccaaggtctccctgaggatcaacatccagccagctgccagaagaggtgatagaggagaaacccatgctcaaccagctcagccgagaatgacgtacacatcagttcccctcacatttcactggatagaatttatcacatggttccacctagatgcaaaggcagttgggaaatgtagtctcctgggtgggtgactgcttacctacaacacttaggaggaggagtatgagtctttggtggatccttggtcatctctgtctcagtattctctttttatttttattttattttactttatttatttattttttgagacagaatcttgctctgactcccaggctggcatgcagatagtaccatctcagctcactgcaacctcagcctcctggtttaagcacttccccctgcctcaggctcctcagtagctgggattacagaggtgcaccaccagttaatttttgtgtttttagtagagacgaagtttcgccatgttggccaggctagtctcaaactcctgacctcaagtgatccacccaccctggccttccaaagtgctgggattacagacgtgagccaccacacctggccagtaagttggcagcagtgggattcaaacccatgcctctgaagagactggagtcttaatacagtgccttagaccgctcggccaccctacctccgtggaaaatattattctctctttaaataaataagttgaaggacagagatttgccacctcacttctcaatgaattaaaatacaatatacaattttctataggtgggagggctcatttgatgcaatgctaaggtttactgttcagctgtggtaatcaagacagtctggttggcagagggacagatgcatgcaacagtggaacagagtagagaacccaagaatagacacgcacaaatgtgcccaaaagatttttgacaaagatgcaaaagcagttcaatggaagataaaaagccttttcaacagatcgtgctggggcaatttgacatccacacgcaagaaacaaagcacattgacctaaacctcacacgttatacaaaacttcactcaaaatggatcatagacttaaagataaaacataaagctataaaacatttagaaaaaagcaggagaaaatcagtcttcagaatctaaggctaggcaaagaattactagatgtgaaaaccaaaagcacaattcataaaaggaaaaaaattgataaatcggacctcatcaaagttgaaaacttttaacccatgagaggcccaattaagaggaggaaaagacaagctacagattaggagaatatatttgcaaactgcatatctgacaaagaactagtacctagaattcttaaaacttgacggaattctcgagaactctcaaaagtcagcagttaaaaaaatccaaatagaaaatgagcaaaagacacaaacaaatatttcactgaaaagaacatgcagatggaaataaacacatgaaaaaatgttcaacatcattagccattagggaaatgcaaattaaggccacaatcggatattgctacacacctatcagaatgaccaaaataaaaaacgatgggaactttcgcattcaatcactggtgaggaatggagacactagaacactcatacattcctgatgggaatgtaaaacggtaccgtattctggaaaacagttttttaaaaactgccttatgacttggcagttgcaatcctggacataaaaatgaaaacttatgtttgtgcaaaaacttatgctcaaatcttcatagcagctctcttcataataggcaaaaactggtaaaccacccggaagcctgtctatggttttttttaactaaaaaaagctgtgttatatccatactatggactgctacttgcaatacaaaggaataaaatattgataacacacaatttgaataaatcttcagagaattatgctgagtgaaaaaaaccagtcctcaaaggttacataaactatatgattccatttatgtaacattcttgaaaccacacaattatagaaatggagaacagattagtggttgccatggctcgggggcagggttgggggtgggagatgggtttggttatacaagggcaatgagggatcctcgtggtgatagaaatgtctgtatcttgactatatcactgtcaatatctttattgtgactgttaacattgggggaaactggaaagggtatatggactctctctgtttatttcttacaactgcatgtaaatctataataatctcaaaagaatacattttaaaaagaatatattatacaattttctatacccagacactactaaatataattatatctttggtaacacagacacactgttctcagataacggaagtagtgcggtgattatgtgtgtgacttgacaatgggatgggctgggttcaaatctcagctaccagtcccttcacctccttgggcctcagtttccacacctgcaggtgctgagcaatgagaggaactgtctcgtggggttgctggggggacacgatgacgtgattcatgagacatgcagagcacaatgctcacttgcagtggctgcccagtaaatgaaattgccacttttccgggctgtagaaaaggctacaggtagaggcaggcagaggattggacccgagagcatcctctgagagctctagattgggatcatgtctcaccagccagggggtttgttttgacttctttcttgcagggaagtgtctgctgagtggtccattccactcccctgagtttggcctggtcgcttcttgtctgccctctggaccccggtgggtgcaaactttcatgggtgtctctccacctggagcctgtggttgggactgctcaggtggggacacagcctggggggtgatcctctgtaaggcaaaatggagcaggagtggaacccatgcctactgcatacctattgtgtgccttgtgacttacgtgctgcagctcacggaattctcccaacaactttgagcagtaggtgctataatcactcctgcgtgatccagagaaaaccgagacttggtgaggggaatggacttgtccaaggttgtgcaactagtaggtggcagagctgagatctgagccctggtctgtctgatttaaatccagaatcattttcactgttgataataacctcaccacttattaagtatctactagagtaatcaatatgctagctctttccattgaggtatgatcacctttccattttagagaagaggaaataggggttaggcaaggtgcattgccaagatggacaacagctctcaaaaaacagccaaccttgcagccaacgggcagctttcttgtgtgcccccaaccccacctgtagctccagcccagctcagccaagatcactcaagctttgggacttttaaatgctgagtcagcaaacagcccctaccttgagatactctgcctaggcagactgtggttgtttgcacttcagcttcaggcctccagggtcagctgagatagcaagaccttcccctgggggctggatggggtcattgggagccactgagagaccctttccccacttggcctggcagacagagtggcagttggaagaggctcgaggtggctgtggtggtaacaacttccttttgagtaataacatttactgaaaagcaattctgcttttagcaccagaagttcaccatccttgcaagcaggcgcctaagaataccttcattcaaccacagttcagagattcacagacttccttttgcactccctccaggagagtttcacatttggtgttgagggaaaaccaaataccacaattattggagggggtgggaggggtgttgagagggaggtgatgcgaaggaggccaggtggcatcaaccacagcccccaaggcctcacaggcagcctctgggcagcggctcagcctctcgccctcagttactggaaagacagcggacgagctcataatgaaaccgacaggctgacaatttatcttccttttacaagaaaaagaaagtgattgtccttcaaacaagcatgactttggaagccagggacttaccctggccactctgcaaattagagacagagccaggctgctccagaggccccgagcccctgcctgtcacccccaattagcgctggagttctttaggctcgttttttctattgcccaaaatccagtctactggggcataatggggacttatggaaagaaaaaaatccaatctgcacttgggaggggatagccttaaatgttaggcactcaccgcaggcagctgggggtggctgagggcaagggagaaggcatgggtggggaaggaggggatgtgccaggcagagccaggaggctccaaaaagcagctctaaaaagctctccccctcccagcaatccagcctcctgactcacgccagacacagaggcagctgatgggatgggaagaggctggctttgggagccacagggatgtgggggcaaactccagctctgccacttgctggctgtgtgaccttgggtgggtaacttcacctctctgagactcagtttcctcacctttaagatgaggatgagtataggaggtcaggacatgaccttcctgtgctcaaaaccctcccacggctcccacctcacttggcagaaagtcaaagatctctgtggcctaccaggccctacaagatctttcccatgcttcccttataacctcatctctctctctctgtctctttttttttttttttttttaagacagggtctcactttgtcacccaggctggagtgcagtggtgccaacacatctcactacagcctcaacctcctgggctcaagtcatcctctcacctcagcctcccagataggtaggactacagacacatgcctccacggccagctaatttttgtattttttgtagtagagatggggttttgccatgttgcccaggctggtctcgaactcctgagctcaagtgatctgcccaccttggccttccaaagtgcttgggattacaggtgtgagtcaccgcgcctggcccatctcctcttactcactctctctggttccctctacccctgccacactgggctcctctttgttcctccaacatgctaagcacacgcctacctcggggcttttgcacacactgtttccgctgccttcagcatccttcctccagatagccacagggcttcttccctctcctgatctgggtgtctgcttaaatgaccccgggggtcctgctctgacccccggcccttccaaattgctcccctggccttacctcttcaccctgcgtgaatgttttcccataacactgaccactacttgacacaataatttagggggttcataactccccattggccagactgtaagctcccagcaggcagaggccagttctccactgtcctccattaaatctcagagcctggcacatagggggcactcatccagcattgaatgaacagatgcagggttttgtggtgagaagggaagaaggacgtgtgtggcgggttcagcaccagcccagggtgcgtgctcactgtcacttcttctctcctctgcccagcaccagccccatgtcatgtgcttgttgaattcctacaatggaaggatgcattttacagatgcaggaatgagaccacagagcccaagcgactgtctcagcccgcagcggggcaaggctttgaattctggtctgcgggtctcttggcctccaggacaatggtgacagtgtccagtctgacttggggtctgggtgagagaaatggctggtggggccatcagactcttgagaagaggccctggctttgaggatctccagccgacatctgggcttaggactggggttcacgccccgtcctcctgtcccacagtcccacattctgccccaaagcagaatgcaagccccatcaaggaggctcagggtttccagagaggggcttcctcaactttctgttgctggaaagttctgtcccagaaagggcagacgcttgaggagctcctggatccggcagaaggctctgagactaggagacccctggtgtcctcgctccccggcaccccgccagttctcgaatacaagggactttccagagaagtcagcctcctggctgcctccaagcctgcccaggcctgcaggcccaggtctccatgaagctcagtcctgcctcggtttccctgtttttaatttcttggagaggccaaggagtttggaggtgaacagcctcatacgagcactaatttcccctaggcctggggcataggaattttggagccataaacaggcttctcacagcccccatgatgagtcctccccacactccatccaccctggactctgggctgagctgggcaaggagctggtctggggtgggctgggtgttgcctgtgggtgcggctcagagctgggggcgctacctctgcccttctgtcccccatcagagctgccccagctgtatgagaacccctcccacaatggctacaacagagggcacgcaagtgagacgccaggaagaactgcttcagcttcgttatcctcaaaggtgttcgtacccatcaagcctcctagagcagacctccatgacagctgcccatgggacaggtccactctggagatatgtttagtttggtccttaaagtatttttttttaatgtgaatcaattgccaacatctgacatgccaggagatttcacataaagtccttttctctggcttctcttgaaaaatgggaagatgtggccatactgggcccacattcctactggacacaggaggcctgggagtggggttgcgggaggccctttcttagtggcacatagtaggtactttcctgttcacccagtccctgcatgccccactttcctcatatcatttccttgccagggtcttgaagtatgagtaggagtgcgccagaaaagggcagtggaaaagcgttccagcaaaggggaacagcgtgagtcggtgagatgcatctgttcaagattcactcgacaaatatgtattgatacttactgtatacacagggacatacagcaagaaaccaaacaaatcaaaatctctgccctctggttctcagctagaggtggttttgttccccatgggacacttggttatgtctggagatgtgtgtggttgtcacagctgggtggagggagggtgctatcagcatctagtggggagaggccaaggaggctgctgaaccaatcctacaaagcccagggcagccttcaggtgcagaatgatctggccccaaatgtcagtcaagccaaggtcgagggaccctggtccgggggcacagacaccaaataggacaagccaatgaactcaaaccgtgaagccagcagctgatgagcactttcggattaaatgagccggagcatggtgagagggatgcagaggggtgtggctgctcaaacaggtgccgtctgcacaggggcaggtcctgaaaagattgtggcactgctggcagggtggccctggcattgtaggtgttcactgagtggcactttcttttttccaccctgcctaatcttcatgacgtccttgctgtggagcagggatctgtgttcctgaccgggcatcgcaagccgttaagaggctgacccagggctcctgaccactcagtcagtgtccttgtgctgcctggaggtagtgatggtctctgaattgcctcctgtcattcagtcagtcaacaaacatctaacaggagcccattggggcatagggggagggagcaacttagggtgaactgctcagcttacaacatgtggtaggtacgcaggaaagactggtgaaaggaatgaaaagaaagaataagtgaataagcaagcctcaggccattaagacaatgatcatggccagcattgattgagtgcctactgtgtggcaggctcatcctaaaccctccatgtgagagtcttacagaaggaacacctctgaaaggggggccaacgaccatccccactttcaaggtgagaagactgaggggaagagaggtgatgtcaactgcccgaggcctagcaagagaatggcaaggctgtcgccggagcctgggcctaccagatcccagggtgcacctgctgcctcagtgttgtgtatgctgtggctcaaatcgttatgccaccggccctgtgagggaggtgctagcattatcccatgttacagatgaggaaaccaagtctcagagacaggaagtgacttgcccaaggtcacacggcatgtgtgtttgaatctagatttcacgttttcagccaccaaaccctgcccctcgtaagccctggccgctctgtgaggaggatgcgtaagtcccaaggggttggggagggaaagtgggccagggagctaagccctccagggtctgcaggaccaggcaggaggctctgaaggaggcagggtccctggtgggcagatgggagcaggtgggcctggggagccgccagccttccgcccccacgtgcaggcatgcccgccaggagggcctgtggagaggccgccccgcggtgtgtgccaggctgacaatggctccttgtgtctgtgccgacggtgggagaggggaggtattgtttgccaggacaccttcccgccaaggctggctgcaggcggtccttgtcctaggacgcttggcacggggctgttccgggcgccagagggaagtgtgtgtgtgcatgtgtgtggctgggtgttctgggccacgttggtgctggctgcggctccctgggtgtgcctgtgcacgtgtgtgtggggtgagggcatgtgtgtctatctgagtgtgcccatgcacgtcttgcacacccatggccagtgtgtctgaatagtcttgtggcttggggcttccatgtgtctccctgggcgtggctgtggctgtgactttacgtctggcaccgtgtgtctctctgtacctctggaccacgtgtggctctgagcacctttggtttgcgtgcccatgtatgtctcagcctgtccctctgcttgtgtctccatctccctcggggtctgtctgtggagcatcttgatcccaagggggcaagaaagcctctgtttcagagtgcgggctgagttccattcgtggctgataggtgagggagggggcttcaggcagagggaatggtgggtgcccaagctggggggcaggatggagttggcagatctgcaagagcagccaggaggctgggtggccgcagtgaagtgagtggaggtgagaggacaccaggggccacctgcaggccagagtccaaagtgaggggcagccatcagaggatctggatgggaccatgacatggtctgtttcatggcaacgcctttggctgcaggtgaaaaatgggttgtagggcaagcctgagaggtgttgggagtcgctgtggccagtgttaggaagcagttccacagcgccacctcaaggaacccccactccatggcaggggttgcaacttccccattttgcagaggtggaaactgaggcccagggaggagaaatgcctcccaaggcctgcagcctgggagctggcccaatgctaaagccaaccctccacctcctccatcttggctgcctgctcctctgcaagtcgctctgcatcttgaggctctggtgacgcctgtgctaaagtcagagaacctggagtcctcgtcaggtcaggaaccaggactctggagccagatgacttgggttcgaatcctgcctctgtagctgtgtgaccttgggcaaatcacttagcctctctgcaccccagtgacctcattggccaaatgggagtgcttgttcatcattacctccaaagtgctgtgccactagatcccacctgtgacagccgcatctcctatccctgctttatttttctccaaaacactcatcaccttctagcatactacatcttgtatttacttccgatgacactggagtgtccgttccacggcattttgggttttttgttcatgagtagtgtctagaacagggtcctgcacatagttggtgctcaggactattttgttgcaagaaccaggtaatacatgtgacatatgggaacacagcctggcacgtagtgggtggaatggaggtgtctgctgttgtcattaagttgggagtaggcacttggaagcaggacagcccagtcaatcctgattaggaatgggtgtcccatctccttttctgcacatccttcttgccttcaggacctgctcagcccactctgggccagacatcttttatattggtctctgaaaatagggagactctggcaggtgctatgagctgctggtttcaagccttatgagggatcagtgacccggtttccccacctgaccacagctgatccagaggcttcgatggtctctgctctctcaggactctcctctgtatattcccctatatatatattccccctgaccaccccactgccccagatcttcccagtccctctgtcggtaaatacagttggcagctctggcaaaaatgtcctgccaatggtacaacgagtcgttggtgaatatttaggaagcccagcgggtttgtcaaggaagcagcttcctgagcataaatatttctaagaaagaatgaaaggaggggcctcggcctcagagatcagtgggtggtgtgctgacctcccaaggtcatcatgtccagtcctctgctgcatggtcattgcttctggtgtcccattggcacctggcatcctggtttcctgagaagggtcaggagctgcagggggaatccaggcccaggcggagaacaacctgctctgtcctctcacttccttcctgcttttcttccagactcccatccctggctgggacatgctgcagttgtcagcagctgcacaggagaagcaggttgggggctgaccagggtagccatggcttccttgaggacccactgtggtgtgggggctttgctcagcgtaactggataaacttggtatcggccctcccctcctgcagctgccaaggttcaggcctcttctcccattcctctctccaccccacatttattgagcacctactatgtgcccagccctcggagacaatgaaaagacctctgccctacctttgccctggttctgatgtccagtatctgtcctgggacagttgtgacagctgctcaattgtccctttcagtctctccctgtcccagcccttccccttccacaacggctgagttcatcttcagaaagtgcaactccagatcttgcttctgctctgctctaaaaccatcaatggctccccgctgcgacctggagaaagtccaaacggcccggctgggtgagcctggtcctgctccatctaccccaactgccctctgcagcttcgttccccacgtcgccagccacgaggatgacccctagtttttcgaacacacctggcccctcccacctccttacccttgctcaagccattcctgccagcccagtgccctttctcagccaacctctcgtgtctgtagccttttgtttgtttctttctttcaggacacatcacacagtgctttgaattgcacttatttatatcttcttttcctcccagagggcaggaagttgccagattcatttctgggcttggcgccaggctcaaagtaggtccttgttagattcgctggctgagctggtgaggatgctgtatttgcgcgggtctggggccacccagcacatgtgtcccttcttctggagaccacgttgagtttcccctgtggtgcctccacccccttggtcttgtgaattaggagagttgaccccatccatcctcagggctgcaggcctggccagtcaggcccctggccacatggattggttcaggggtaagcacacgatccaatcagggccaagaaattaaaccggcgactttggaatgggaaagacgttgccgccttgaggtggctgagctcgttgtaggatgtcagcctggagcagctgaggcactgtgccaccctgagaaacagagaccgcctgagaatgccagtgacatggggcaaagcagagccaagaggcgcagacagcccccagacgaaaatcgtcagcggtgctcctggatccagctgtatctgaagcagacatggctctctcattctccctttttaaaacccaccttgggttgggtttccattgcctgcagctacaagaaatcctgacaaatagctgagccttctgaatatacatctcatcaccttactgtccgcactgccatgaccccatgcgaaattctctcatgaggaacccctttgaatatccaaagctgggggaggcgtctcttcctccacagagctagtttcttttctcactcatgggcaatatgagcaatgatcgctggttctggttgcctcaagctccttttggaataaggaaaagagcaagtggaataacctaaaggactaaaatgggctcgagttcccaggggctaaggctgggccctcagccccactactgttcagcatggacaggcacacagcagatgcttctcggccattcactgcttgacagtgcaaggcaagctttctcaacctgggccctcgggcattctggactggctgcttctctgtgaaatacgccaggtttggttaggagcgagttgcccagtctgtgttctactgacatttagtgccaaataactcctggttgggggctgtcccatgcattgcaggacttgtttagcagtgtccctggcctcactacccgctagatgccagtagcacctccttccctgagttgtgacagccacacatatctccagacgttgccaaacattccttgcagggcaaaatcaccccctggttgagaatatctgctgtaagcaaagtgtgtctcacaggacctggcacatagcaagtgctcaataaatatcagcaaagatggttcggtgacgatgatgctaaagatgatcactgaggaaatttggggcctcagtgagatccagatttggctgacttaagtgggaaggaaatttattagaggaacatgagtgagcttacagaatttatgagaaagcggaagagtcagttcaaaacaacccagaaacggaggcagttcagtaggtcccgacagcaagaagcagatatgctgatagcggcaatgagctattcccgtttcagccatccccccacttcctccttcctaacagaacctattttgctcattttgcacaagaaatccctgcccccacccctcccatgggctccaggaagatgggcctcagccaagcctcaggggactgattcccgttgctctaagtcagccacagtgtcccccaccccaacaaggccagtgattgatttaggctggacatggaatgtgattttagccaatgagatgtgttgagaaatttgttagaggcttctgggaaaggtttccttgctcttcgagatagaggtttatttcactttgtataatccaggttttcttctttttgaaggctgaataatgttctgtggtttttttttttttttttttttttttttttttgagacagtttcgctcttgttgcccaggctggagtgcaatggcgcgatcttggctcactgcaacctctacctcccgggttcaagcaggccccatatgtgtggcctgtgcagaaagagactggcagcctggaggggtgagacctgggtggaaatgaagaattcaaccaaagcaagtaaagaaactgccagaagcttgagcccccgagaagctcccgatgtctgggggtaatcccaggatctccatctttttttttttttgagacggagtttcgctcttgttgcccaggctagagtgcaatggcacgatctcggctcactgcaacctctgcctcccgggttcaagcaattctcatgtctcagcctcctgagtagctgggactacaggcgtctgccaccacacccagctaatttttgtatttttagtggagacgaggtttcaccgtgttggacaggctggtctcaaactcctgacctcaaatgatccaccggcctcagcctcccaaagtgctgggattacaggcgtgagccaccacacccggccggatctccatcttttaaaaaacatgactttcttctctgggcaggtgggaggctgagggacacctcagcgttaagccaaaaacagccgaggcagcattcatgcctcctccttccaaaggcccccatgtctccaggggttgggagcctccagctctaggctgcggggatcccctctgccattcaggcccagcccctctacactgggccctgagcatgtacctggctcccccagtgtacccgagggccttgctgtcaccggatggattgagcaactcaaccgagtgtgcattttccagctcaggctaaccaccattcagtcacttcccctcacgttcatagaccagttggttccttgtcatttctcaggggacaccatgacccttcttgtgaactctccatgatgcaggcgagaatctgagtcacccagagctagcaacctgattcacctttgtcccccaaacccctggcctggctctcagatgaaaacaaataataataataataatgaatatagccactaattcctacagtgtcctgagagctttacaggtacctgcactgactttcaggtaggtacatgcttgtccccatttcctagatgaggagactgagtcccagagaaggtgagtaacttgcttataagggaagaaggagtcgtgatctgaagctaagcaatagggtggatacattcaagcatgtttggttagacatttagcaaaacacctttgctgaaaaaaaagttttgaaaaaaagttatgaaaaaaaaagattggaaactctatttttaaatgtatcaccagcttgggaggccaaggtgggcggatcacctgaggtcaggaattcgagaccagcctggccaacatggtgaaaccccgtctctactaaaaatacaaaaaaaaaaaaaaaaaattagccaggcgtggtggcagacacctgtaatcccagttactccagaggctgaagcaggagaatcacttgtacccaggagatggaggttgcggtgagctgagatcacaccattgcactccagcctgggcaagaagagtgaaactccgtctcaaaaaaataaaaataaaaataaataaatgtatcaccagctccatccattcatcagacacatgtttccatagtagataccttgtgcctggaaggttcttcttacgagggacatgggagtgaacaaacaggtaaggtcccctcccccctggaacttgtagtccagtgaacacaatcaatccatttaggacttgaacatttgaaattgagacttccctgtacctataattatcagaactgtatgagatcctgaggtggaaagatggtgacttctgtgggcttttttgctcaaacacaattctttaagaaagagacctgcatctcgggctgcccaccgcagtgtgaggatgtgagaaagacccagggacctcacagaccatgtgatgtcacagaaggcacaggactgccaggtgcagtgggtcacactgtaatcccagcactttgggaggcaaacatgggggtgtcgcttgaggtcaggagttcaagaccagcctgagcaacacagcaagactctgtctctgcaaaaaaccaaaaaccaaaaccacagggcggggaggtcagaccagctgcctggaatcccagcccagaccctcaccagcatgtgacccaggacgggccacgtgctgtctcctcaggaagcctcaattttctcatctggagacagggacaatgaatcccttccaggatcactgtgaaaagacaggttgagcatctctaattcgcaaatctgaaatccgaaatgctcccaaatctgaaactttctgagtgcggacctgatgccgtaagtgaaagcccgcggttttctgttgtcgctgttgtttcacggctgagccccctatctgctgatatcgctgttctgcttggtcgccctgaactccttattttcccactgtattaatgctatgtcatactttttaccatggagtacttatgtgtgagtaagtgtgagacaatgattgcttattgatagcatataaattcagagtcaggaataagggtgatgccaaacaaccacagattgtccacgtgggtaactgagataggtgtgggacgcctttctttctgttggtgcgatgcacacaaaatttgtttcatgcacaaaattattaaaaattatgtacaattgcattcaggctgtgtgtataaggtttgtatgaaacataagtaaaggtcatgttcagatttgggtcccatccctaagatatctcattgtgtatatgcaaatattccaaaatttggaaaatataaaaatccaaaagacttctggtcctaagcattttggataagggatcccttagacggtaccctgtgtcaatgtgggatatactatgtaggaaaatgtattcgtggttcaacccccagtcggcctgagggaaagtcgattccagaaaggccaagtgatgaaagttcttcatctttgtggacctcatctgggctcaaacacatattacagacctcagtgtcaaaggagccctgaagtcccttcaacaagggttggctgggtgaggactgtggcggcctggagggtagctgcgactcagcctccacggggaacgcatcccagtcatgccaaaaagccatcttcctcaagagaagccagagatccagattttgatagaaactctcccaatttttaggccaggcgcagtggctcacacctgccagcactttcggaggctaaggcgggcagatcacctgcggtcaggagttcaagaccagcctagccaacacggtgaaaccctgtctctactaaaaatacaaaaaaaaaaaaaaaaattagccaggtgtggtggcctgtgatcccagctattcgggaggctgaggcaggggaatcccttgaatccaggaggcagaggttgcagtgagctgagatcatgccactgcactcctgcctggacaacagagagagactgagtctcaaaaaaataaaaataaaaaaataagaaactgtcccagtttttaaacgtttgccactaatgacggcaaagcattggcctgccaccttgcaccttctgggatggcaaatgatcaaaaacacagacactagcaaatgttggtgggggtgtgagcagctagaactctcatatcttgctggcgggattgtaaagaggtacagccgatttggaaaacagtccagcagttccccaaaagtgtagattgagttaccacatgacccagacattccacttctaggtatatacccaagagatacagaagtatatgtctgcgcaaaaacttacacacaaatgttcacagcagcacaattcattacagctgcacagtgaaaacagctccaatggccatcactggatgaatgggtgaaccccatgtggtgggtccatacaatgggatattagttggcaataaaaataatgaacgacaaactcatgctacagtgtgaatgaacctcgaaaacgtggtgctgagtgaaagaagccagacacaaaaggccacatagggcacgattccattcctaggaaatgcccagaagtggcagatctgtagaaacagcaagtagattggtggtttggggaggctgggatgagggcatatggggagtaggcatgggatacggggcgttttggggaggtggtgaaaatgttctaaaattgattgtggtgatggttgcacaactctgtgaatgtacttaaaaccattgaattgtacatttttacagcgcgaattttatggtaggtgaattatattttgatagagctgttaaaatacaaaagtgctggcctaacagagccccttggtgggttagagtcaaccactggccacgctttttccattccttgattccagaggttatcctcagttatccggaaacttcagccacctggaacaccggttcctgcgcatgaggcgggactgtcccagaaggcagagtttccccatggggcccagcagtgacagagaaacaccctggaatgggaggtgaggggtgttgctgctgacacttgcctttttgcttttttgtaaaaatcagccattaaatgtaggcagagaaaggctctgtaggtaacttctagccccagacaagaaggaagtggagtgggtgagctggtgggaaaacagtggtgggcagaggccaggtgaggccgtgcagatcctgggtggcctgagaggaggttcagcaggacaagcgctgacctgaacgctggctggttttgccccttcgcccatcagccagtggcttagcagctactgcatgtcaggcactgtgctgggtggtgggagaatgtcacatgggagcgtcttaggaacatccacacaggggaaggagctggagagaatctgggaagacctctccggggaggtgacatttcagctgagacttgaatgaagtgacatccggggcaggggatctgcgtgggggacaggaactgcaagtgcacaggctgtagcgtgcctggccccagagaaagaggctgcggagctgcagccaaggggaagagggagacagggtcggttaggaggtcagggaaaccacgagggaggtcccagaccaggcagggccttgcgggctgttgtgaggactttgactttgctctaaaagagctgggagccatgcaaagctctgagcagagagtcctgacctgacctcggttctaatagtagccctccagcccaaggggagaatgggttggggtaggggcggagcagggaggccaggtgactgcgggaggccagaggggagcagggaacaatggctggtccagggtggtgcaggatgaggtgggagaagatagtcgttgttttctctcactgcacaatgtacctgctgtgcagagatacagggcaggtgaaaccggagattccacacatatattagacacacacacgcacacacacatacactctcatatatgtcctgtgtagatatggatcctatgcacatatttcacacacactcatatatgtccacatagatgtagattctatatgtatattatacacacacatatatattctaccttcatataggttctacacatatattacacacatttatattttgcatacatatagatttggcacatatattagacacacattcgatattcatatagattacctatagaatacctacttatttgcattctatttgtatgtgtggattcgagacatattatacacacacatatagactgcatacatagagatttgacacatgtactatacacacacactcatagactctacatacacatagatttgtcacacatattataaaccaagttgaccctgagttctggcagccagggtctgtgaacttggctcttggaaggggctcagctctggagttagggagtgcaggatctgctgcttagagctgtgggattcaggctttgcttctctgaacctcattttcctcatctttaaaatgggatgacaatacctgccttgcagggttgttgggaagtcttggtgagatcaccatttatgcaaagcagctgatctgctcgggaagactatttaatagcagtcatcacactaataacgaggtgtgttttggggccaagcaaaccccacggagcaccttcctggaacacaggtgtgcaccacgcctacacgccctctctcctgctcagccagaatgggaaaaggagtaggcctggggcctctgtttgggaaggatggaccaagaactccaatggaaacctatgagtcagcaacaggcataaaacagttaatgggtgcgccgcttcagctacagtaatgatggggagatggaagcctagataacatccagaaggcaggtggattagtcagggctgtctcagttgcaaggaacaaaaatccaactaaaaccagtttaggtgaaagataatttattgggtcacataaaaaaattccagggaggcttgcttcaggcatagctagatccaggtgtttgaatgatattgttttccacgtctctctggaagactgagttaatcaatatatatgaagcaccaactaccacacctaatgctcagtaaatactagctatcattttattactacaactgctgctgctactgccactgtgactacgactcccactgatactaatatgaccctatcagcccagcgacccagagggaagctccagcactctttctcaaccattcctatcaaagcccccagactggctctcattggctgtgactggatcatgtggccatctctcaccctgccccgtggcccatggccaggtcctcagtcacaacgacatccttgaagctgggggtgggtcagctttgctcaaactccatggactgagagtgatagagcgagactccttaatggaatatcagaaagacagagagtggagactggccaggtccagccatccttcatgtgggccctggcggggccatctctgctgcctgcctgtcccccacatggaggttggctgtgcctgtccagtcatcctcttacatgctaggtagtctcccatccttcccatcacttgggagtcctgaggcctagaattttccacaatgttactttcattgcacaagaggcctctggagttgaacggacttaggtttgatactcagtttcattgcttagttagcttcacctccctgtgcctcagtttcccccatttgtgaaatgtggataatgattctcacttccttaattcagcagatattttatggaacactatttctggtacttagtggctaccacctgctttaacactttcattttgactcgcaacaaccctgagagttcaatataaccatccatttttacacatgaggaaactgaggcacagagaggcacagtcacttgtccaaggtcccctaccaagaaggagaggcagagctgggatttgaacccaggggtgatcaagctcaatggctgtccatgtcgcccgtgcttcacctgaggaggctggcgaggtgtatcctctttcacctgcctcagttttcctcatctgtgaaacggcctcatggctttggagcaaacagaatgacagataaaagggacaaatgacacagggctctccatttgtttaacaagtacttattgagaacctactgtgtgcagggcaccaagccaggctgtggagaaaacagaagcgggtgacaggatgggagaggttccagaagccgctaggaggagaaggcagttgagctgtgacctggggcaggtggatgggcctccctgggaagatctgggtgtgggaagcgcctgccaggcagggggcacctcaagtgcaaaggccctgaggtgtggacaggtgagagaagaccaggacaagccccgctgttgccgtcgtctggaaaccaaggcacaaagagaggaggggacggagccaaggccacgcagctggcagaggtggagctgggatgttaggggaggaacagaggtcacgacctctgcaagcttcatcccccacccctcacccccagccagaatcttccagaggggtggcctccccttcctgagccaccccagctgttgcggaggctgctgctgtcctggttcccttgtttaattacaaacaacatttttcgccctcacttaattatgcaacagacgcccgtggatctgccaccatctggccccactttctggcttgagacgacgagtcgcagtgacttcgagggctgagaggggagcaagcgggaggcacctcggccaggagggcaccgagcttggcatggcctcagctctgtgatgtacctggccacatctctgagtcctcatctgcagaattgggacaattgagggctggcgcaagggtctgtgagacaagagctgcttggcaaagaggagccctcagccctaaagggggcctcgaggggccaggatgccatccccgggaggcagagttagcccctcctgtgtctcaaaagtagagtagagagggttcaattccaccttccggcaagctgcgtgggcagcagagttcccattccgcagatgggaagaatgaggctccaagaggctcagggacttgcctgaggccctggcatctgagtgtgggagtgggttcatggctccaaagtcctccatttccacatgagtgtcttgcaaactgcaatttttcttgggctgtcagttatgaggggaacagccctcccctggtttatcccccgggagcttggtgtggggctctgtgtgtggccctgcgtcagctatgaagtcctggttgatttgaagccaaaactggcccttccagctggggaggggagcaagtgtgaattattttcaatgccctaattaataataatagtaatattcactgacaattactaaatactgactatgcaccaggtactttccatgaattatctcattttcaaatgatcaccagccttctgagggaggcgctgctgtgcccaccccaccggtgaggagcccaaggcactgaacacggggttgcgtaggtaggattcgaacccaggccctgcagacagcagagactggcgctgctgagagtcgactgtggaacacggggctttttctggctctgtccttttctggcctttctttaagaggcagcaccagcagctggattccactttgagttgcagtgtgtcctggggttggaactctgggaaaatcccaacagcaagcatcccgggctgcctcctgcaggtgcatgggttgaagacatctatgcagaggctggacttgtccaggaaggggtgggaggcatagatatcagggccttcggccccccaggagccatgaggtgcaaagagatgcctgcaaggccccttgcctaggctgcctcgccagctagaagcttctgagccactctccagtcctctgcttatcattcccatcaaactcatgagctgggcctggcggacacaccccctcaacacctcactccagctcctggcctgacctggccccagcctcgcctcctcctcatctccctgcaccgccctcacccctaggatccattctccacacaggattagggggagcctgctaggacccaaggctgacagtgcccctcccttggtgaaacacttttgagggctccccactgctcttggactaaccccctaagtcttgttgcagcctccgtggccttgcatggtgtctctcagtaatctctgcacttgccggcctcccctctgtctccagaacctactcagacagtttccacctcaggacctttgcattctctgtgccctttgcctcgacttctctgccactggatcatacagccgtatcatcctagtccacactgtggccagagcaagcttcctgaaccctgcatctcagcaggtcctctgctgcctaagtcttctcttgggctgaacaccccatccccaaatccaaagccctggatggggctgaggctgcctgcgccccctccagcctcctctcctgagcttcttttagtgcccccaaaggcctgcctttgtgccagggtttctcagcctcgggctggaccattctccattgcagggctgtcctgtgctctgaaggacactaagcagcgtccaaggccttggtccactggatgccagcagcaccttccccagttgtgaaaactaacatctccagaccaccaaatgttcccggggagaacaaaatcaccgcagtcgggaccccctgggcgaggcttttgtccctgctgtgctctcttttggggacactccccaccagccctctgcacccaccctgctcagccctctgtgtatttcacaacccttagatgccacctgcgaggaaccttcccagcccaggcaggtcaggaggcttctgggtgctcccacaatgccttatactcatcatcggagacctgatgatgccatcttgtaattgtcagggggcatgttggcccacccctcaccccgcccctggggatgtcagctccacaagggcgggctccatgtctgctctgtcctccaccgcgtgacacgcacaagcaccgagcacagggcctggcgcgaaggggatgctcagttcacatttcaccatctctccacttgtctctgcctctgtcctcattcatcacaaacacaccccaagtccacacatgtgtgggtgccgcgagtgctgacaagaatcagacgtggttcctgccctcagcccactcacactagcgggcaacacaacacagtaggggagccacaggggacctggcagctccaaagaggcatctgatccaaactatggggaagaagggagggtcaagatgggcttcctgggggaggtgacgtctggatgactgaaaggatgaaaaggaggatcagcaaaaatagtgccaggatacggggtacccaacgtagtgaatgtcctaaatgccactgacttgttcactttaaaatgtttaatcgcatgtcacatgaatttcacctcaattattacaaataaaaaaatagtgcaaatagagggactagaatgtgtaaatgtctggtggacagaaactgaaggtcatttcactggagctgcaggtcaaaggagcagatattggaagtggtgatgagacaggagagctggccaggggccctgtggccacagagaggagtctgggctttttcttgagtgagtgggagtcacagaaggtcgtaggcagaggaaggaatgtggagaagagagtgggtgaggctggaagcaggaagagcagagaaggggcgatggccacagtccacgggtgagagggaggagcctggcccagggcttggccagggaggtgaggagatgtggttggatataggagatatttagggcataaacccgacagttacgatggtgtagatgtggaaggtgagaggggagcatcacggacaatgtccgtgttgcctcagtcaggaacccatccaggacctgcccccatgtcccccaagagccttctatgcgggggcaggtgcagggacccagctctgtgcttccctcctcaggggctctgcctcccccaaggctctgtaaggggtggtcttggcactcccatgaccttctgtgtgacctctggctaatctcttggcctctctgggcctgtttctggggcatctttgtctactcttccgggaggagtgagaggcactccgcccaggcagaggaccttgaagaacctgtcctgcagggtgaggccctcacccgcccctcctggggtactcagcaggtgaggggacacctggtgcacagcctgggcaagagacccagctccaccacgccctgcacggctgactggcctctgctcacctgagggacgctggggtccaatcctccaatcccaggggctgtgcccccaggcccagcctgggattctgagcctcacactctggccaggcctgggggatgaacaccctccgtcagcagcctggggtcaagggcatgagggctggagccagggccttggggcaaatcccagctctgccccttcctgctgagctgccttacgcaagtgactcaacctctctgatgcccaaagaaagagatctgtcatggaggctacatcccacacaagtggggcttttccacacggggtgggtatgagtcccggttcacacactggcactgtggagtttctttgtgttttcacaaatggaactgattttccatcttgtgtcgtggttatgccaggctggaggaggcttcatctgacggtgattcccaccctcgccaccaccccactccacttttcctgggaaggctctgggtcccctggcctttcatgaggccaaggtgttggggataggaatgaggacagaggcactggtgttgggtgtcgtcttcccaccaggcattgcctgacacaggctggtcccccccctgaggccctgcgtggttctgtgcctgccccttctccattgcccctggtcctgggggtcatttggctgcttcctggctacttcaagggctggttggaggctgcctttccagaatcctggaaaagctgcttctacctgaggttctgggcctcactgggctcagccccaggctgggggccacccctgacaccccgtctctgtacctatcctgcgaccctggctctgattctgggtgggggaaccttgctctctgcaagacgtgagttcttcctgctcttctcaacttttgaaactcaaaagccaggaagcctcctgggatccccgtacttggtgtccccgcccttcccggaggcactgagtacagacttacagtggggaaggacggaagggagaaaggaagagagcaggggcctaggtgggtgcagggcagggaagagaggccagttctgcagcctccccagacagtggccctcgggatccctttacattttaaaaaactgctgagaaccccaaggagctcttcttgcttgtgtggattctatcagtcgatactcacgttagaaatgaaaactaagaaatgtataacatatttatttattcactcaaatgtaataataaatccattacatgaacataacattttttataataaatacctatgcattttaaaatggacaaatttaatgagaaaagtggcatttgttggattgtggatatttctgcatctctctgtaacagctggcctctgggggacagcgggtcctcacacttgcttctgcagtggatctgctgtgagactttgtttaggatgaagtacctgagaaaacctggcttccaaaggcacatcgttggaaaaagggaggatattgtcacattgtgaaatacatgtatattgagacggagtctcactctgtcgcccaggctggagtgcagtggcgtaatctaggctcactgcagcctccggctcctgggttcaagtgattctcctgcctcagcctcccgagtagctgggattacagacatctgctgccatgcccggctaattttggtatttttagtagaaatggagtttcaccatgttggccaggctggtctctaactcccgacctcaggtgatttgcctgcctcggcctcccagagtgctgggattacacgcatgagccactacacccagccatgaatagtctttaatgctacacaaaaactaatcagtggtaatgtcttaaattcagatgcaatgtggaatctaaacatctatcaatgaacttttcaaactctttacactcatgtgagaatgagagtaaacagggcaaataatcctacgaaccccttaatgggtcttggggacccctagggatcttcggaccacacttttagaactgttgtgttctctacaatggacacgaactcatcattttttatggctgcatagtattccatggtgtatatgtgccacattttcttaatccagtctatcattgttggacatttgggttggttccaagtcttcgctattgtgaatagtgccgcaataaacatacgtgtgcatgtgtctttatagcagcatgatttataatcctttgggtatatacccagtaatgggattgctgggtcaaacggtatttctagggacatggatgaagctggaaaccatcattctcagcaaactatcgcaaggacaaaaaaccaaacaccgcatgttctcactcataggtgggaattgaacagtgagaacacatggacacaggaaggggaacatcacacatcaggcctgttgtgaggtggggggagtggggagggatagcatttggaggtatacctaatgttaaatgatgagttactgggtgcagcacaccaacatggcacatgtatacatatgtaactaacctgcacgttgtgcacatgtaccctaaaacttaaagtacaataataaaaaaaaaaaagaactgttgtgttctcaaagagaagtatcccagcagtcagaaagctgctggttgacccccaccagggacataccagggtatgatgaagaatgcaggttcaattcccatttctgctgcttcctggctgtgtgtctctggggaggtcactgcttctctaagtctcaatgtcttcatttctaaaacggtgataagaagacctaccttacaggcttgtggtcaggacccatgaaaagcaggatgtgaatgcaaagcccttgctcatatgtgttcctttctgccacagggcctttgcgcgggctgttccctccatctgaaaccccttccctcccggttttgccaagggaactcctttccctttagctcttggcttaagtgcttcttcctccaagaagccttccctgacttccctggaacgtctgttagaaacccctagagcatgatcaaagctttatatttttcagggttataggtgattatctgtctcccaccaatccctaagcctgggttgacttttgccctctgccgtaggagcttgtgtggaatgaatgctgttgaaagaatattggtgataaagtgccatctttgctgatatcttggtttttccatccttggaatgaaaaagctgggctttgacaaggggtccctccccaacccccaccttctctgccagcagctggactgcaccaagcaggggcaggtggaggggggctcatgctctgaagctgcaggggttctctcgggggacccagccctgcctgagccccctttatgtggggtaccccggaggcctctggggtcatgctccccatctcgcagctctttcctttctgcacatggtacctgccctgccctagagcaatctctcaagcatccaggctggcagacgcccttctccctcccctactctcccttcagatgggctcagtcaaggatttcttctctgcaaccccaagccgactgtatctctgtgtccctgccatcatggcacatatcccataccctcatcttccccaaccaggcagcacgttcctcaaaggccaggattgtgtcttcatcatcttcgtccccctgggatcagacagtgggcctggtgtccagtaagtgtccaatacatatttgctaaaatgacacgaatgcaggactctgggagaggttcctcttatcgaaggaggttgtacaagttagctttgggctgcaaggaatagaaactcagctcacactgatttaaagcataaaaggcacttactggcttgtattaatgaaaagcctagtagaagggtgagcttcagggttggtttgatcagagcttcaactcttttcctctgcgatttacccagttctgcttccgtgtgttgtttttgtttgtttgtttgtttgtttgtttcctctggctggttttcttcacggcgttgaaacaagcatgactgttccaggtctcgttctgtccagatgaagatctcttcgagtggctacttggaatgcactccagaggcccctgacattgattcttctctagactcaaactaacctagttacatgtccgccctcgaaccagcggctgcagccgaaggtgagatttggaaaattagcttagatttggtgtcaggaaggcgatcagctccccaaaaagggggaccacacgagagaagtgtggcaatcccctcaaaatacgagtagttaccaagagaagagaaagtgggcaagaccgtcaaagcatccactcgaggagtttaattatattcaaacccatagcaaaaaaagaagctgttttttgagcaaaaaccaacccagggaaaactttgctaaacgtccagatatttcaccagaaccttctgtcaaacataagaagataacagatttctgtactctctgactgaattttgctgaccaaatccaaagtcagttcacagagccacagatgactttactgaatttttttaaaaatgtgtttgtttttccgattatgataacaatacatgcttgttgttaaaatatttaaataatgcagaaaagcatttaaaatagtagttctcaaccaagggtggttttgtcccccaggagacatgtggcaatatctggatacatttttggttgttaggatagggggtaggggttagctcctggcatctagtggggagaggccagggatgccactagacatcccacagcgcccaggacagtcccccgcaatgaaaattatctgacccaaaatgtcaatagtgtcaaggttgagaaaccctgatttaaaggaatgtaaaaattaccccaaatcctactgtccagaaataaacactgccgacattttggcaaacatcatttagaatactctttttaatatatgcccattgcacacacaacttaatacaaatgagattatgcacatgaaaatgcttttctctacaatgtcatggctgtctctctgtattgctgtttttgtttgtttgttttttgagacagagtctcgctctggtacccaggctggagtgtagtggcatgatctcggctcactgcagcctccgcctcccaggttcaagccattctcctgcctcagcctcccgagtagctgggattacaggcgcccgtcaccacgcccggctaatttttgaatttttagtagagatggggttttgccatgttcgtcaggctggtctcaaactcctgcccttgtgatccacccgccttggccttccaaagtgctgggattacaagtgtgagccaccacacccggccctctatattgccattttaatgagtatttttaatacagcttaacacaatgttttatatttatttaatgcaatttcataaatttttaatacagcatttcattatatgaggactattgtttgcttaatgaatcttctgtagtttggcatttcagaattttttcccccaatttttcactattataaacaatgctgcaatgaacgaccttccccgtagagactacttggcctattagaataaatgcccccaagttaaatttccaggttgctttaaaatttctgcccagtgaacagcatggtgcttgttgccattctgctcccagagacccttgtagagtccgttcgggacagtatgagaatccccattatcccatactctgcaacactgagagttgccaatcttttttgtcttttctaatctgataggcagaaaatgacatatcattgtagcttatcattgataactggtggggtggaacttgtcttcatacttttttttctttttttctgaggcagtgtctccctttgtctcccaggctggagtgcagtggcaccatctcagctcctacatcagcctcccaagtagctgggactacaggcatatgccaccacacctgtctaattttccttattttttgtagagatgagatctttctgtgttacccaggctggtcttaaactcctgggctcaagcaatccttccacctcggcctcccaaagtgctgggattataggcatgagctgcctcgcctgccagaatagtgggtttttaatacggtgtttacctcttcttattgttttgcaagaactctttgtatattaaggatagtaattctttctaagagtcttataattgactataaaagtctccctccctccctccttcccctccctccctcccttccttccttccttccttccttccttttgttcccttctgctttctaaggatatgcctggtgtttggcaagcattgcatgaattacattaggaaataacttttgtaacaaacccatttaacaaccattctttgttccccgcctcctgataatgctcagagccacagcaacagcctttgcccaactccatgtcattaacccttgatcttttcctgctgaatagcagattgctttccggggctggcaacacagtttcattttcaccttcctgctgatggaactgccctggctctgtgccagatggctgtttacataagaaatgatttgattatattgcacagccaatggcagcctttctcagaataaagaagccagaaacatataatcaaagccattaactgtgtacaaagaaacgcagcccactctaaatttcccaccaaccataatcacagttttccagagaaaaataagaacagggttatggttccctactaaaaacgtgttaggggaaagacttttaaaaggaaattgtggtatagctcagttgcactctcagatcaacccttgagccttgactccaatcccagctctgtaactcactgtccttgtgaccttggaaaagtcgtttactgccaaaagcctccgtttctttattgtaaaatggctataatagtaatatcaacctcagaggtttacgagaggattaagtgagatagtgcataagaacactttctcagtcagaatgttttcagccgcaaggagcagaacacttgactaaaggagggaaaaaaaagctagaggacttataattttatttaacagggttgtttcatttggaggcataaagatgtaaccagtgattcacattcttttcttcttcctgctatgccattctcagcaatttatggacatgtctcctcatggtttcaagacagctgctgtggctccaggcatcacactgggacatgataaaatcaagcaaagaggaggagggcattttttcccctgtgtctcctttcatgatggagaaaattgttcccaaatttcccccctgcagatctgcagacttcttattggccaagatggcgttacatctataattccaaaccagtcactgatggaggaatgagaatgactgcagttggcttggacctataactcactctgaagccggggcgaggaatagccaccgtccctgagctcctgagtagatgcacaaccaacaaaactgaatcccgtcagcgaaggagtcatgggtgggcaacccgtgctgtgtctaccataagcacaactcctggtgctcatgaggtgcccccaaaggctggcatttggcaagctcaagactgggagtccacacagtgctccaggtgggaggatcacaaccgcgattggccagggagtccctctgggtgccagacccctgtatgcaaagccccactcagcatctccacttgattggcttatgggaacctcaaatccaacacactatatttgaactcatcatatttcctccccactggcctcctctgttggtacccaccttgctcaagccagaagctggctggtcctcaggagtccctgctttccttccccatctgtgcccacgtctctccagctctgccatcatcttccacctggacaccaaccaagcccccgctctccctgctgctgtgtgggcatcaacagcctatgctgttccctctgaacggaactcttcccgctcctgtttccctgtcaccttgctcaggaaagctcttctgatccccccaagttgaatccctcattacaaacctcacatcctgacatacatctctccattgccctgatcatacttcttatttacctgtgtgattatttcactcatgtctcaccccaccaggttgcagctccatgagggtgggaattgggtctgttttgttcactgataaccttcagtgcctgacacatagtagggcctcaattttattcctgaatcccataaatgaataaattcatcccctgccctgtggccagggagatcactctaagaagcaaatctaatcactccctctcctgccataagccttccatggctcccctttacccacaggacaaagtctaaagggcttaacctggctctttcaggctcctcaaagtggattctgccacctctccagccccatctcacctgccccattgtcctttacggtccagccaccctctactcctttaggtgtctcaaagtctgcatgttctctcctatccctggatttgcctatatgctatgtttctcccggaaactttgtctcaaaaaatcttcattctcattgccaaggctttaaaatttgcctcttttggggaaggtttagttctgtaagctcattctggaaatctgggttccttctatctagctgttgtcatcctcagtccatagcttccagtcaagtccaaaacagctgctatagcttctccgtcacatctacgttccaggcagtggggagagagaaagggtcattcctcttaagggcatgactcagaagcagtgctatcacttctactcaatcccattggctggagctcagtcatatgaccatgcctaactgcaaaggaggccgggaaatagaatcactatctgccgattatgttagcatgtttcccactaatgctccaaaattctctcagtatgagaaaaaagctgatggatgttggtggacactgatggtcctgccacactcacccccacagtgccagtcatggacttatctctgcccagccagactgtgagctccctaaggacagggaccatatatggtggtcattgcagcatcccctgcaactcacagagtgctggttgtgacatatggcaaatcagagtgaattgcagaggccggaaatacaaggtggagaaactgaggcaggcaccagttgagttccacacacattttctgggtgctgattacacataagaaccctgggcttggtcccggtgcctggggggcagcaacacttgtctggcctggcagtgtccccaaaagcacccagttgggggctgcaaggccccacccggtggggaagctgcagaaacagagcagagtccacagtcagaacaggaggcgccacaagggcctacaggtaaggcaggtcccaggccctcagcccacctggccctggccctgctgcactcttggccactccccaacattatctggccttgggcccagccctgagcacctgcccttccctgctctcccgagaggcctgagctggggttcccctcccctgtcggctgccgtgggaaaggccttatggtagctctcaaggtccaagttccagcctcaacagctgccgtacttgctattccctctggccagacctcccttccgtgctgctctagcttctcctgctctcagcttagacggcacctcctcactgtctccaaagaccaccgcccaccccggtgcctctccaccacattgtgcatcttgttgcttcccagcatgggtctgtgtggggtcgtaggggaatcctgctcttgttcattcatttgttggcttctttgctcgctgtctcccccagtagagacatggacattttctgtcttgttttccactgtatccagagcctagcccagggcctggcacctagtaggtgttcaggtaatatctatggactacctacatacacacacagtgaggaaagacaagagaattagcactcactgcactcgtatgacatgccagcgcatgcgttgttcactctgaggcccacgacatcattgcctggttggaatcattatctccatttcacagtggaggaaactgagactcagagaaatgaagtgactcgaccgaggttacgccaataggaagggccaagtctcagacggggggggatatttataacgaaatgcaaagatcttggaggagggggtggattcttggttgtacacatcgatcaaagctcatcaaactgtacagttgaaatcagaggttctcaaccaagcatggttttacccccaggagacattcagcaaagtgcagagacatttggtcatcatgggggtaagcaatgctactggcatctcgtgggtagaggccagagatgccgctcaacatcctacagtgcccaggacagccgccacagcaaagaattatctgacccaaaatgtcagtagtgctaggttgagaaactctgctttgaaggaatgtagtttactgaacacaaattatgtactccatttattaaggcataatcaatgcattttttgtaaaatagaaaaaatagaaaagaactaacataattggaaaagaaaggaaccaactaagtacaaaacaatggccacataatttaaaaaggcaaagaacagatcagaaaatacaaagagcctatatgtaaatgacaaggggctccaccttaatactaataagggaaattcaaattataacaaaaagctggggggttgcctcatgtctgtaatcccagctctttgggatgctgagttaggagaatcacttgaagccaggagtttgggagcagcctgggcaacatagtgagaccccatctctacaaaaatttaaaaattagctaggtgtggtggcgtgagtctgtagtcccagcttctcaggaggctgaggcaggaggatcgcttgagcccaggagtttgaggctgcagtgagctatagctaaaaaaaaaattacaacaaaaataatcacaatgggaaaaaatttttttaaatgacagatggggccaggcgcggtggctcacacctgtaatcccagcactttgggaggccgaggcaggcggatcatgaggtcaggagattgagaccatcctggctaacatggtgaaaccccgtctctactaaaaatacaaaaattagccgggcgtggtggcgggcgcctgtagtcccagctactcaggaggctgaggcaggaggatggcgtgaacctgggaggcggagcttgcagtgagccgagatcgcgccattgcactccagcctgggcgacagagcaagactccgtctcaaaaaaaaaaaaaagacagctaggctggtgagtgtgggggaagtaggccctctcatcctctcctttgtggatggagggagtgcaaactggcaaagccctggcggtggtgtggtagcactttgcatcatttgtctagcaatcccagttgtgcagaaatacacatgcgctcagagagctgtgtgcggatgctcactgtggtattgtttataatagtgaagtttaggctggaaaactaaatatcaatgaaatcaatgaacgtggaattaggtaaataaaccatggtgcattcatgccatggaatactatgtagcagatcaaaatgataaggcaaatctctacacacatagttaggcggaacaaaaaaagcgggctgcaaaaccacatttgcaatctgtttcgaatcaggtggcacaaaagaaatccagggcccaggccgctagcgcttgccatcattcatcaccccttctccccacttttgaatggggcggcaatgtgcccaagtgaaataagacctccccagcctcccctgaaaccacgcgggtgcaatgtagtagccatgagacccagagcgcacacactttgtcccttccctgccctcttgccttgctgagaagcaaccctcttgagccaggagtttgaaagtcacataccaacatgggagaccaggaagctggtcattggtgatgtccctgaacaagcctacaagcccagacttgctcacctctagacttctttttacacaagagaagtgaactcccattgggtgaaaccctggtgtttgttattttttacttgcagccaagtgcaatttcagaggcagcaaactcactggggaggaggacggttgagtcttctgcaacagaactgtattcaagtgtcatttacatagttaagacttttctaaaataaatcaatacatcaaataaagcctgtctggctagagtctgtgggactcttgctgtttctttcaaaaagtgtttgttgattggctcaggtccctctcaacccaggcaaaaatgccaaggggaagatggagggacatcgaggggtttccctgtgacctgctgaaggagaggttggaatgctgttttcttaggaaaagctccattttcctggtaagaggactagcgcctgagtctctcactccagggaggctcaggggtcagtccaaccagcccaacccgggctgcccctatcataattggtgaccctctagcctagacatgctagcctccaggcagtgacctggctgtctctcccacctgtttgtcctcttcccagaaggaggatgctccctttatctcaggccaaagtacccccctcaccctcccagggaaggggaggaatgccacctgtcatcacgggatgggtgagtcacctcttactggctggaggccatagccagcccaacctctctcttttgccccctagctctcccctgtgggtggggaacgatgggaatatcaccctaaaaatcgtgacagcaacagctgccatctctgtggcatggaacctgtcactggaagcttgagtgcacagccctgggttccaagcccagctctcatgttctaacctggtgatctggggggagtcaccccttcctgatccccatttatgcatttggcaaacgtttattatgcaagcactctgaaccgggcagggggtgctgaggatgccacaacgaacaccccgaaacaatcctgccctgtggaacccattaggtagagacgttcaaaactaacaataatgataatgttaataaattttaaaattccgagtgtcaattggtgatgatgtcacagagagaaggggcgaggagtgctggtgcagaggtcttgttcatgtaagcaggtggtctaggacgccctgagatactttgaaaatggaggaaagggctgggtgtggtggctcacacctgtagtcccagcactttgggaggccaaggaagtcagatcacctgaggtcaggagtttgagaccatcctagccaacatggcgaaaccctgtctctactaaaaatacaaaaattagctgggcgtggtggtgaatgcctgtaatcccagctactcgggaggctgaggcaggagaattgcttgaacccaggaggcggagattgcagtaagccaagatcatgctactgcactccagcctggtgtctcaaaaaaagaaagaaaaaagacaaagaaaaaataaaatggggggaagacctggaggaggtgagagagggaggcttgtggttctctcagggcacagagtctcaggaagagagaacagcaagtacaaaggtcctgaggctgccgtgtgactgatgtgttccaggagcagggaggaggccagtgtggctggaaggaagatgccagaaaggcagagtgggggtgtactaccacacgggatttagggacactgccaggaccttgtctttgactgtgggtgacatgggagccagaggagggtgttgagcagaggagagatgtgatccgacttcctttgggtagcaagacaatgatggaatgggggaggtagttcggaagccatggcaacaatccaagcacacacactcatgccagggcggggctgcggaccttggagggtggtaggatcctggatgcaggctgtggatgggaggtggtggggcagaggctagagaaagagaagagtcaatgaggacactcaggtgtttggcctgagcccctggaaggagagaggtgccactttcagaggcaaagacgatgcaggagaggtaggatcctgctggaggaggcgtttggtttcttacctgggatgtccgagatgcctgttaggcatattgagtcgtagctggatattcaagactgagttcaaggcaggaaatgtatggttagaggcttttagcttggagatagtatttagagactcagtttctttgtctgtaaggtggagattaaacagcatctgctttgcaaggttgctgtgagcctgggttgaggactgagagttcatgggcaggtagcaaagtgcaggtaaatgtcagctccgttacttccacacccagctcactcaatcctcatgaggtcgttattattgccatcagctttaattttacagggagtggaggttcagagaggttaagtgactggtccaaggtcacatagcctgaaaacagcgcagccaggatccaaggctgaatctagagtcttgttcttggctttctaccctgctgcctcctccctgctctcccagcaccaggcccttggatcttgaactgatcagacttgaggggctcccagttgggaagggagacaaccgtgagtggaaatgcctccaggcagacaggacctgagcctgccccactagggggcaaattagaaggggggccagtgaggcagcacagccatgtggttaagggaagcactgtgatgccagaccacctgggtccaatttggctctatcctcactaggtgtgtgatcctggagatgtgactcatgtttatttgtgcctcagtttctgctgctgtgaaatgggataatacaggttattgggaggactgaatgagttggtccatgcaaagtgcttagaacaggaccagaaactcaataggcgctccagctcactttccaccaaacgtgtgcccccagggcctggggccacctgccatgtctttgggtccacatctgtcccttgctcaaggttcacatcttgccttggctgctgtgagctatgtgtttttgggtttctcacccaacttccctgcactcacacttcctttgaccccaaagtgggaaccatatctaccagtggtgaggatcaacatgcacagtgcctgcagaggacactggattgtaactgtgacaggcctcaagtgggtgctcagtgtgcacaaatgttcatgacagctggaaacccagatgtcctcctgcagtggaacgctactcagtcacaaaaaggaacaagtgcgtgatatttgcaacaatgcaatacatcttgcaggcattgtgttgagaccaaaaagaacgctcctggtttttgaaactctagatgaaacacaactaaactttggtgacagcaagcagatcagtggctccctcggctgggccagggatggggagtttggaaagggatatagggaacttcgttttagaaatgttttgaatgttgttttgggtgtttgattcattggaattcatcagactaaacccgtaagacctgtgcattgattgcatgttcatcatatcccacttttaaaaatttttatttttatttaattttattttttgagacaaagtctcactgtgtcgcccaggctggagtggagtggcacaattacagctcactgcagccttgaccttcccaggttcaggcgatcgtcccacctcagcctcctgagtagctggaaacacagacgtacatcaccatgcccagctaatttttctactttttgtagagatggggtctcactatgttgcccagggtggtctcaaactcctgggctcaagtgatcctctggcttctgcctcccaaattgctgggattacaggcgtgagccaccgtgcccggcccccaattattttaaaaagcaacaaaaaagtttgtcgttgtcatcatcataaatttgttcttatttctctgactgttctatggcaccaagtgcccccttagccccctcttttgaggccagcagagacccagagctaagtttggggtgacttttccctacctctggtccatcaaaggtctctgccacataaggcagatgagctggcactgtagaaagagccctcagacccaggtccaaacctgactctggctctgcctcgtccttgctggctgcccctgagtgggtcatttaagcctcagtttcctcatctgttaaatggggctaatagtggcgcccctgcttgtgaggtggttgccaggattcatggagattcttagagataagaggtgtgcagggccgtggatattggaggctcacagaaacaaaacagaacaaagcaaaaacccccaaaggaaaaaaaaacccaaaaccaaaataaggcgaagcagctgggagagggtgggggtgactgagcgcagcggcctggcgccagagtgccgggcatcaggtcctgctcctgggccatcgccgtcacctctctgtgcctcagtttctgcatttgtaaagcaaggatgataccagcacccagcccacaggctgtgtgagggctgattgagtcactcatggagacagagcagtgcgtggtgcctggtgcatgcggctgttatactgagggttgggaaggggaggagcgcaccacctcgggggtaactcagagagcccagtccttcttgaattgctgcctggcccaggccatggtgtcccagcaggtgaaggggtgggcagtccagctgccagccctgtcagatgcagccgcaggggctgtggctcaccaaggcccggggcctgtcctgggctcctcacttggctctcgtggctgggacagattgcttccttcctctctcctgggtgccaggtaggcccagaaaccacctgatgtcagcaaggcctggccacccactggtggggaggaagtgggcgggtgcccagggacagatgagccgggcagacgtgccctgaggcagcacagtcagggctgacgtgggcattatgcacctcggggctttcagagctggctccggtcccgtttgcccacatcaagcaggtcagagtggagagggccaggggcgctggggtcaaggcatgcactgaccaggcgtctgtccccactcctcaaaacacagccaggagatgagcgcactggggtggtggcctgtggaagaggggcagggtctgtgtccagatgtggccggagggtggggtcgactgtgtgcggtacgtgtgtatggaggtgactgtgtgtctggcatgtgaatgtaagattttaggaaggtgagtgagcttgtgcacaggtgtgtgtgtgtgcacgtgtgtggctaagcatgtgtgagtgagtaggcatctgtgtgccgtgtgtgggagccgggcagggggcagcgtgtatggctgagtgtgccagcacattgctgagcatgtactcgtgtgcgtctgggtgtgtgaatgacaaaataagtgtatatggttaattacatgagtgtgtgagtgagtgtggggaggggatgtgtgtatccttgattgtgggagtcagagtgtgtgtatgtgtgtgtgtgtatgtacatgcgctgttgtgaagagttctgcaagaacccctccccttttttaaattttattttttgagatggagtcttgctctgttgcccaggctggagcacagtggtgcgaccttggctcactgcaacctctgcatcccggcttcaagcaattctcctgcctcagcctcccgggaagctgggattacacacgcgcaacaccacgccccgataatttttgtattttttttttagtagagacggggtttcaccatgttggccaggctggtcttgaactcctgaactcaggtgatccacccgcctgggcctcccaaagtgctgggattacaggtgtgagccaccgtgcccagccaagaaaccccttttgcatacagagctttgctcctttgcacgaaaatgcttatgaacaggtggggtcagctggtggatgtgtttaaaattttgacagaaatggccaaggagctctttagaaagggcagaggggagcggtgatatccaagttgatccctgaccagtcagaacaggtgtcagctgcaaatacccaagccagctgagccagccctggtcactccaacttctgctcccaccagcagcatccaagaaggcttgaccttgagtcattctcaggccatccccaaagcaaacagtgaatggtgagctttataataacaaagtcaacatattataatctcatgggccgtcagttacaatggcaaacattcattcattcattcattcaccaatattcactgagcacctactatgccccaggcacagtttctggtgctggggatgcagccaagaacaagacggacaaaaattcctttgctggtggcgctggtgggaacaagcagacgacaaaataagtgaacagcctgtggagagggttaattggtggtaagtgctgtagataaaaataaagcaggaacagtagatccagaacgccaggtgggtttgcagttttaaaaagactggtcagttggggctccaagggaagcaggcgtttgggtgaagacctgaaggaggtgagggccaagccacatggatctctagcggaaaagcaaagcaacccccaggcagaggccacggcaagcgcaaagggccggcgacagcacacacttggccagttcaaggaacagagaaggggccagtgtggatttagtagctttttaaaaactaatgataaaagcaaatggtgcttgtggaaccaccacacagaaaaacgaatacaagagaaattgaaagtccacagtcgctgaagggtgggggcaggggagatggactaaggatccgggtgtctggggtacagttcacttgataatcaaagcaattttccgttttgacaaggcaacgccaaaatagcgcagctgcatccaaacctcccagccgcagcgaaacacccggcgtttttacactcgtaccccagcccgaccctgagccaggcacgtagtaggcgctcggtctgcttctacatcctcccagctccctgggtcctgagggggcgaggaaagatgagtgcaaaccccccaaggtacagactgacttatccccagatccccacaggccgccagccaggcccccagcggccccggaatgacagcgtcgtctcttcctcctcctgcttttatgagctgtgaaggaggcttgtctcgcgttgcacaattgccccttaattgctatttcctctcagttatgaattatgtcatggatatggccgctcacgttattaaacttccacacaggccttatcgtctggagtccggccagcaacccagcctgacctactttcccaccggatttcaaaaccgcctcccttgtcctctcgttggacttttcctaaggagagtctactgtgcccaaaaacttgacgctaaaaataaaaactagaacggagaaggggggccacagctggccccaccgaaggcctgaggctcggagaagtccctggtgactggggccaaacccctcccttcctagaagcttcctcagaaaacctgtccttgcgatgcagggttcccagcaggacaggcagggacaccagccatagtcccaggtcccctgcgtgatcagatcccactctcgcctttctcggtcatggccgggatgactgactttggaggcaggcaaacctgggttcaaaccttagctctgacactgactagcccattcattcattcattcattcactccaggtattgactgtctcctgagtgctggccctgtgctgggcagtggggaaatatctgagaacgaggcagacacagtcgctgccctcatagaacttttaatctagtaggcagagatgggcacaaaacacaaattctgaaattagggcaatgaagaaaataagacagtgcggtaggtttgagaacagcagggctgcccgtttgagacagtcagggagaactctctgtgcggaggggtcatttaagcaaagaccccagtcatgagaagagccggatccaggaagccagccctaatgagggaggggctcaggaggtgcctcgcatgcaggatagaaggaggcgcttgctctcagtctcagccacgcgcaggttggcatttgagagtgagagcctcctgaaagcttcaccctggggatctcacttgccccaacctagtcctgggcctgctgggaaggaaaggcatctaagcaaagggcgcagcgaatgcaaaggccctgcagtgggatgagcctggcgctctggtgcagagagagccagggaagagtgcagtgcagggatggggacgtgggtgaagctggagaggtgggggtgcagaccacagagggcctcgaaggccatgctgaggatttggtaagggagaagctctattgtgagggcagagctggcaatcctcgtgggtgaggtgatatttgccggggaggtagggaagactcagggtgcatttctaggccggatgacttcttgattgatgtaggagagattagcaagtgcttcatttctcagtctttaatattcttcatctgggaagtgggaataataacatcaacctccccagagaaggtaccatacttagcacagtgatttacctgggtcacccaggaagttcgtggctcagccaggactggaacccaggccctgctctccaggatgatcgcaacaggcaggggctggatcttggcatgagattctccagcgatgccacctcccggccaaacaggcctcagcagcaggggctggatttttttctttctgaattgtgcttatgcgtggggctgtttatctaacttggctgaagtttgagtcctgggtctgtaaacatacccttttaattattatacaaatggtacatgttcgtggaataaaaatttgaaaatgaaaataagcaagaagaaaaagaacgagagagaaagagggaggaaggagggaaggaaggaaggaaggaaggagggagggagggagggaggggagggagggaggaaggaaggaaggaaggatctaaatcaacacatgtacacctagatgcattatataaggaccttcattgcagcatcctttgacataacaaaagcctccaaacaatgtgaatatccaagattaggggccttcgtagctgcatgaattaaagagtatttcaatcctgtgctgagactgaagtgaataaagcagatatcgctgtactgatttgaaacaacagccaagatgtaatattagcctagaaaaatgagatgaaaaacagtgattatagaatgctacaaagtgtgtgtgggtgtgtgtctgtgtgtgtgtgtgtgtgtgtgtctgtgtgtgcgtgtgtgtgtttgtgtgtgtgtctctgtgtgtgtgtgtctgtgtgtctgtgtgtgtgtgtctctgtgtgtctgtgtgtgtgtgtctgtgtgtgtcttaaggagagagtgaggaatgtgtttacctatttgctggtagatgctcaggtttcctgactttcgcgtggtaaaaatggcaagtcagagatgggaggaaggatgatattttgcctgtccgtttgcactgttgaaaggaaaacttgtggcttctgtttttgtttttgttttgccatgtgcgtgcctgtcttctgtgcaacattttagcaatatttgaaaaatcagagacttttcgaaaggccctgagataatctaggctggcgtttcctgaaagttcccccaaatcccaggattccagcaaggtgcctgtaggccatggggcttggggtggagctgcaggcagcctgaccctccttactcagagatgtttctctttcatcttttttttataggttggacaagtaaaggttcagttgtaaaagggttttgcctgctttgaaacgaaatttttgaaaaactttgatcttgaataatctcttcattctaccgatgaggagacaggaacccagaaaggagaaaaaaaggatcgtctcagcatcaggctgacctgggtttcagtctagctttggctgcgtgccttggatagtaaattttcctccttgaaccttggcttcttcctccagggagaaaaacctacctgaaggtgattagtacacagatatcaaaagtggaagtagaccctgagtccttagctaaggactagaacgatcgtggcagaaacgtgcacaggaaatcatgtggcctctgtctcaccagcgggtgttccaggaatggcaaaagtgttcccttttccccatttcactcaagtctagaatcaggcatatctcagtttgttagaagtcagctcactacaaaacccaggtattccctgggacacatgcaactgcaaggggcagggaaactcaactcaaatgactttatcattaaggaagtgtgtcttcctgtacattcagaaaacccagagatggcatggcggctctgacaggcatgcattcagcttcgaggaacacagaccctgacccctggcagcatttatttatattgtcccctgctacaagaaatccagaggcatccagagctgatggggtgactcaggggtgctaccaggggttcaggttctttcccagttttgttgttgttgttgttattgttttgagacagagtctcactctatcgcccaggctggagggcaatggtgtgatcttggctcactgcaacctctgcctcctgtgctcaagcaattctcctgcctcagcctcccgagtagttgagagtacaggcgcccgccaccacgcctggctaagttttgtatttttggtagagacgtggttttgccatgttggcgaggctggtcttgaactcctgacctcaagtgatctgcccgtctcagcctcccaaagtgctgggattacaggcatgagccgccgcacctggtcactttcccagtttttgcttagccatctcgaacatgtggcttctgtcctcatggttggccataattgcagcatgaccattccaccctcagctcatgtccacattacaggctggaagaggggacaagggcagagcagtgtgtccaccatgtttgtctcttttcagaaagctcttctgggggccccactgggaaaatttggctttcatatcattggtcatgctggatcacgtggccattcctggctgcaaggcagtctaggggagtgagtgcgttttgctggctcattgccatcccaataaagtcagggttctgtcaacaaggaagaaaaggagcgagggcattgggcaggcactgagcagtgtctgccccagtagttcaagaattgttgatacaatggctgaaagacatcttccaaaacctgtgttctctttctgtttgcattctaccatcctcagtgtgtgggcttccatcctgagacttgttttatcccctcagtttcaggagggggtcccttccttgaaggcatgtgctgatgccccctcaaaaaaaagtgttctcccacctagggaggagagttgaaaagagctgtggttgggcagttgacaatgtctgctccacctctattcaccggaacttcttctgttccatcctcttttcagttcagctcactgcgatttcatttccatctcacagcgtggatcagtcacctatgcctacaagaatgctgcctgagaaaccacccccaacctgttattctcttgaatagggagttggctgcaggttggtggaccttggctggacccattaatatatttcctgttcagctggagttctgctgtcttggctgggctggctctgctctgcctcacgggtccctcgcccttttcctgggaccaatgggccattctgggcatggctgctgatagtgggggcacaggcacaacagccacgtggaaacatgcaagagatctctttttttctttttttgagatgcagtctcactctgtcacccaggctggagtgcagtggcgtgatctcaactcactgcaaccttcgcctcctgggttcaagcaattctcctgcctcagcctcccgagtagctgggattacaggtgtgtgccatcatgctcagctaattattttgtctctctttctttctttttctttccctttctttctttctttctttctttctttctttctttctttctttctttctttctttctttcctttccttccttccttccttctttttttttttttttgagatggagtcttgctctgtcacccaggctggagtgcaatggcgcggatctctgctcactgcagcctctgcctcctgggttcaagcgattctcctgcctcagcctcctgagtagctgggattacaggtgtgcatcaccacacccagctaattttttgtatttttagtagagatggggtttctccacgttggccaggctggtctcgaactcctgacctcgttatctgcctgcctcagcctcccaaagtgctgggattacagatgtgagccactgcgccccgcccaattgttttatatttttagtagagctggggtttcactatgttggccaggctggtatcaaactcctgacttgtgacccgctgcctcagcctcccaaagtgctgggattacaggcatgagccaccacgcccagccacattcaagagatcttaaagcttggtctcaaaatgacacactgtcactttcatctcatgctattggcaaaagcaagtcccatggccgaactgaagtcaaggctgggcaaatacactccatcccttttgtgggaggaaccacagtcacatgggcgactgtcttccttatcatcactgtttgctgatgttcctccgatctctctgactttgttttggtctcatatatgggttcctcttctctctcccttcaaacactgtggggccctaagcgttccatgccagctcttctcttctgtctctatgtgtggtctctgggccatcccaaccattctctagttttcagtcaccacgttggcactaaagacccccaaatccattagtgggctctctcctgagtccagttgccaactgggcaggccacctgaacatctcacagaactcccagatctttctcctgctttgacctcagcaccctcagcctcagccccacctcaaactccctcctcctttattcccatggcacacaaccccctccatgcagctgcccaatctgggaacctggatgtcagcaagcccacctgtctccatggtccgttcatgctacagctgatgctgatcatgaccactggctgagtacttcctgtgcgccaaggacagggctaagcctcatcccaatattttctgatttaattcctgaaacacccgcccccctccccccaccctccgaggaggggggcactgatatcaagttgtctgtattccatatggcacatgccctcatgggacaggtggcttctttcagaagctgcagtgatctctcccaaaccaattggttctgtcaatccccagtgaaaaatccttaagaatcctcattgtcccagagacctgggctaaaccccttggtctgaagcggtcaggtccaagattctttcatttattcacacacaaaaggaaatgattgcgctcactccataagccagtcagcctctgggcgctggagaaacatgagaggccctgggaacttaggcccaacggcaagagagaaaataataaatatctaacatgtcaggtagtgacgaacagatatgaagacaaataaggcaaggcgaggggagacttatttgagaagggtcactatttcaggagggaattcagggtcagcctctctgctaagaagggattgcaatgaagtaagggggtggcaagtgcaaaggcactggggtagaaaggggcttggtggccgcctgtgcaatgagtgtgagaggtggaagaggctacaatatgggcgtggcttcctccctgagtgaagtagggagccatgggagggttttgagcagaggagggccctgccctgactttgatttttacagaatccctctggctacttgtggataacagtcttcatgggggccaggaagcggagaagtctgctgcaggaagcgaggttttgcaggcctcatgacacttagatcacagagaggattcaggggtttgagtgacattctcaaaagacacaggaaaaccaaacaggattttcgggttaaccagaagctgccagaagatggacggtgcccagcatgccctgcccccaggcaccctggtccatgggccttttgtgcagcatcctcggcgggtgtggacgctgtggtgctggtgttgctggtgggttttcccctgtgcctgcctcttggctgttgaggacagtgctggggaggatgtgagcacttagcaccccagcgtggtccgggcgatggtggcccagctcccgccaaagacgctgacttctttgaacccgagaacaaacattgacgttcttagttctgcaaaaaaaaaaaaaaaaaagccctgcgtccatgcacgctgtatccccccatcaccaaactcacttatctcgctgcacaatccttcaaagcacaacacaatgtatttatgtctgtggtttaggttcccaaaacctgtgacatcagataagtacgatgttcacaaaaacaaacatcgcagaaagggaaaaaaacgaccaaaaagaagcagctggtttcagcctcgacttcctctcccaagaaaaaggggctctatctggctgaggtttcactgtattcaggctggggggtcagaggaatgccgtcctgccctctgtccaactgctcgcatctcagcctttgatgtgtgactctctgaggctgaaaaatctcacctgcaaaatggaaatgccaatctccacctcttgggactcataaaaataataataaaatgataataaaaatataccaataattgctcatctttggatcaattgtgttccataggtcatttccttagcaaatcctcacatcggcctgtgttttgccttcacgtggggtggctactgagaacatctccagttgacacatggggaaactgaggcttcaagtaggaaaaataggcagttataaaacactgcatggctacttttggtttttagaaaatgcaaacatgtaatatataaattaaataaataaataacaaaatataaaaatataattaggcaaaaaagtttggccggttaaatgcccaaaagccacagtgctttcctgagtatcagagtgaccattgagacaggagtcccaccgctgtctccttctcgtcattcccgtctcggcaaaatgtcacctctgctgagaggtcgtccccaagctcttgcctaaggtggccctccggtccctcttattccactcaccttatctctttctgccctgaccgtcgctggaatgcgccgtattttttcatctgtttctgggcttatcgcctgtgttccccgctagagcttcagacccaggaaagcaggaacttcaccccgtccccagagccttgcccagtgcctggcactagtggatctcaatacatattcctggaccaacggaaggtgttttcttatttttaaaaaatgtactttgcacactgggcaaggtggctcacacctgtaatcccagcactttgggtggatgaggcgggaggatcgcttgagtctaggagttcaacacccatctgggcaacatagtgagaccctatctctataaaaaaaaaaaaattaaagtattagcagggcgtggtgatacctgcctgtagttccagctactccggaggctgaagtgggaggactgcttgaacccaagaggtcgaggctgcagtgagccgtaatcatgccactgcactccagccttggtgacagctagaccttgtctcaaaaataaaaatacaaagtgaaaaaattgctttgctttttcaaaagcaaagcacaccatatgagttgtttttaattgttgttttaagtgctggtcaaaaatgagctggcaggagcctcagcaggaaggcacagcctcggcgggcttatctggctgagtgtgaaggaagtgggcacactggcttcccacagagtgggtcaagcagcgaacatcccagagtttcccagcccagtctgcccccagttctctggcgctggagatcttcccgcctgggacagggttatctttgaatgacagcgtgttcagtctcccccatggggtgaggctgccctgaatctcagggagcaacagggatcccctgggccaaacacagcccccaggagatgttgcttggcccatgcagttcaaacagcttggaattttggcattattttaaaaatcaagatattttggaagaaaactttgaaaatcctcccaaagggcaccaaataagatgagaataattggatgggaagatttcacatccttaagatgaccattctgccaacatacataaaacttaatgcaatttaaagtagcgacccacaaggtttttttagttggataaaacaatctttgagttcacaaagaaaaaagtacaaaatgaaagaacaatgagaaggatcaggacaaagataatatttcaactcactgggaaaatggaatatttaatccaggaccccagccgagcccactatcagcaaaaaacaaaaatggactcccatcttctactacaaatccagggagttcacataaaacacctggcttgtccaaaagtcccgaccacactgggcccttatttttgcaaggcagcaatggattgatgctgagttgcatctcggggactctccacttcaccacagtctccaccattccctactgcatcccacctgactgccttcaatcatctgtgtgtcttgcttgggtgttcgtagcctctgaactcactacacaacagaaggactcagggaacctttgaagttggatttctgctgttagccacctttgtactgttctcattttgcatagtggaaatgtgtatttagaggagggatgtggcttcaggcatgattaagagcatgattaagttggtccacctgggccgggcgcggtggctcaggcctgcaattccaatgctttggaaggctaaggtgggaggaatgcctgaggccaggagttcaagaccagcctgggtgacagagcgagaccctgcctctaaaaaagaaaaaagaaagaaagaaaaagagcatggagctagaagctagagaggcttgagcaacctgtgaagagcgacttccccgctcagtgcctcagtttcctcctctgccacatggggataataagagctgtcacacatcatgttagttgcagagatttgtgccattctgcaaaattcttagcccggggcccagtgcagtgtcggtgccagggaaacagtggtgatgacaaaaccctccctttacatctacggcttttagttctcaggcttctaagggaggaaagaaaaaggaagaaacgaagggaggaggggtgcagagcggagcatttgcttttacctttgatctccttttgccaaaaaggaggggagaaagtaaataaacaggcctggcctcctttgattccagcgcctgcccggcacagagctccagagctgataagaaccagccaagttctaactgggcaactccaccctcctgaccaggccttcccttggcatttggaatccaggacgccaaagccctcccctgcaccctactgtcagcatgcaccgttaatgcccttctcgccttcccaaccatgggagaaaagatggagagaacttccccactgtggaaccccacacaaaacaattgggcgggtttggagacaagaaaagggtcttagaaagcggcttccgaatacattagaaacccagtcccccatcccaggaagaagcccccacactggggacttgcaggaaaacaaaatgctcagggatttgtcttggcaatgaattaagcagaaggctggtgaagttctcggcgcagagcagaaccacccctcccaccccccagtggttggtggagagaagccgtgtggcacggtgggtaatggtatagctttgaacccattcgtttatggttgtgtgactttgggcaagtgactcggccctgtcgaacttcagtttctcatcagccctggcactgggctcatgggattgttaaaggttaactgaggttgtgcccatcgggtgcctggcgcatacatagcaggtgcttgtgcttggacactgtgattataaaatggcttagggagtcccaggatggcctcaggaggagagacaaaaaaaaaaaaatgctcaggcctcatgtccggaaagatgaaagaggatcagtttgaaatctctaaaggcaccaagggccatgcagtggccaaggtcaggcaccgggtctgcttgaagttgacaggaggtaaattcaggacaaagtttagcatacacagaagacattccttccacattccccccaggtaggccctagctgatggctctaagagcttccccaggacctctgctaaatagctcagagctaaggcagagggcctgggagaagaggcagaggtgaggggtccctcccacccctgcctcctcctggctgtgtgacctgtgtgcctggcctcagtttctccacctgtaaaatgaggccataataacaccaaccctgtaggttttgaggatagaacacatggcattctgctggtgctcaatgaatgaacaaaagtcacaaaccacagctacttccaggatgaggctgtggaagcggttgtcagcagggaaagaactgactgctcttgactcctttcttaggaagtccaggctcaattccacatccacgccccgtccacctaccctggaggcagggcctcgctctgcttcgcacattcgcaagtccccagggcctggcatagagcaagtatttgttcaatgaatgcatgagcctggatactctgtggagtcaacctccactgagagcaaagggaggcccagagaggccaggtaacttgcccgaggcctcacagccccctgcctgcctgaaggcagagctggaactggggctgagctgagcctggtctgcacccctacttgctctgggccttcccctcggggaagcctgctgtcccccacctgaacacaccctgcccaggcttcccccacccagcagagcaggcacaaggagctcctcaggtggaaggagctcctccttccacgagtgttccagacgctcactgacctctgcagggactggccttcccctctctccctggtaggctgaaggccaccagcttgccacctgcaggcctcgtctggcttcagacgagttccgttatgacctgcactgtgtggttttgtataacctgcactgcatgggtttccttcatcattttgaatcatttgccaacatttaaaaattggcgatttcgtataaaacccagaatttccagcttctttcggaaagtcggcctctctggccaccaggcctgcttttttctggctctggtcagcaggagcttcgtcctaggcctcttcactcccctcgctctgacctggtggtcctcactcaaccctgggcctactctcccaggcttacagcctccttacataaaggcccaggcctgcccggagaccaggccactcgctcccccgccaccgtgcggtgcctcctccgttcaccctcagcccgggcactcccagggaaagccaaaaaggcaggattggagccaaactctaggtgtccagtagacagaataatgaccccccaaaggtgcccacctcctaatccccagagcctgtgaacatgtgaccttacatggcaaagggactttgtaggtgtgattcaattcagggtcttgagatgggaagatgagcctggcttatccagtggacccaaggcagtcaccaggggccttatgagagggaggcgggagggtcaggcccagagggcccacttcgactccagtgggagcagaggtgggagcggtgcaagccagtgagtgccattggcctcaagacaaggcatggattctcccctgaagcctccagaaggaactccatactgcctgcaccttgattttcccctcgtaagacccactttggctttctgactttcagaacagtaaggtcatgaaagtgtgtcattttcagtttggtgtaatctgttacagcagcaataggaaacatcccagggtttgaacccaggcttggccactccctggctatatgccctggggcaggtgacatagtactgagcctgggttttcccgtctgaaaagggggtgagcagagacttctgttaggtgggggctgtgtgtgggggtgaagtcgatggcacaggtaaggtgtggggcagagccctgacagctcacgcgctagacgccaccatggttagcatcgccctcttacttcctctcacttctctcactgtcactgaaaccaactcagagcaggcttttgaatctgcccactgctgcccaagataaagacgaaacttcctacttaggatcctacacaatctgccttccctaataataataacagtaatgattaaaacaataatgtccactagcactgatgaagcacttggcaagagccagatattaactacgtattaaactcatttaggccaggtgcagtggctcacactcatcccagtgctttaggaggcaaggtgggagaatcgcttgaggccaggagttcaagaccagcctgggcaacatagcaagacccccaatccctacaaaaaataaaaaatttgccatgtgtggtggcatgtacctatagtcccagctactcaggaggcagagatggaaaggattgcttgagccctggaggttgaggctgcagtgagctgagatatcaccactgcactccagcctgggtgacagagtgagtgagacccagactcaaaaaaacacacacaaaaaattatttaggccagatgcagtggctcttgcctgtaattccagcaccttgggaggctgaggtagaaagatcgcctaaggctaggagtttgagacctgactgggcaacagagtgagacctcatctctccaaaaaaattaaaaattagccaggcatggtggtgtgcacctgtagtcccagctattcagtgggctaaggcaggcagatcgcttgagctcaggagttgggaggctgcagtgagctatgatcaagccactgcactccaaccggggtgacagagtgagactctgtttctaaaataaataaataataacttcgaaaattcacttaatgctcacgacaatcctatcacttgccctatttttctgataggtaaactgaggcccaaaagattaagtcacttgcccaggatcccctggcaggctggtagctagctgggatttgaacccacgtggttgggtcttggagcctggatgctaaccatggggccgtgctgcctgtatatatgagcagaccagggaataacactcagggccccagggagtggccagagactcagtgatcatggcctcccctccatacactgcctgtcctgggtacaatcctggacccgagagatctgagggtcgtggctcctcctggtacacagtttgtacccacaagtgtgtttattttgcaaaacagtttccagcagtgcccactctctgccggacacctggtttccagaaaaaatgcagacccctccactgtacttaagatggtggagacaggccgggtgtggtggctcacgcctgtaatcccagcactttgggaggccgaggcaggcggatcacctgaggtcacgagttcgagatcagcctggccaacatggcgaaaccctgtctctactaaaaatacaaaattagccgggcgtggcagtgggcgcctgtaatcccagctactcaggaatcacttgcacctgggaggcggaggttgcagtgagttgagatcgcgccattgcactccagcctgggcgacagagcaagactctgtctcaaaacaacaacaacaacaataaaagattgtggaaacagatgagtgcctaggctgtcacagcccagtgagggacggcaggggcctgggggcagggggaggtcgggggaagctccctgaggcagggccatctgaggagaagcccaaggaagctgacgctggcatccttgaacagctgagctgagtgccgcaaggaggatccgcccaggaaggccccggtgagaggaagcccgtgtgcttggagaggtggatgtggtcacaggtggctggagtgctggagagagtggaaacgtcaagaggtcggcctgggctcggccacttactgtgtgaccttgggcaaacttcaccgcttttctgagcctcagtgtccgcatctgtaaaatgggaataggatagcagggtacctcctggggtggttctgaggatgcgacgcgtcactgcgtgtgaaggtcagcgcctggcatcgggaagggctgcattggtgtgagtcggtcttgttgctgtgattatgatgaatacgaagcatcgcgttgtcagcctgcacgccacctccccttccaatcagctcctcagatgcagaagccgtgaagctcccacaagttcatggggacaacccgtgtgagaccagtgaggaccccctgcctgtggggagggatgtcttcccaagaagtttcatgtctgccatcccagacccgggatccaggccggcgtctacactccctggggttcccagcttcaggcagcttagccctctgcccggtgtttgctctccgtgtccctcctgtccttttgtgtatgacacgtgtccttcccccgctcccttgagctccttcctcatcttcaccaatacgatttgtcagtcactctcaatgcccaagttcctctttttcaagcacgttaacaatacgaattgctgagagtttttgagcacttgctatgtgcctgatactttcattcatttattcattcagcaagtagcctgaacacatcttgtgtgcattggagatcttcagaaataacagacaaaggtccttgcactccctgctgggcttaacatcttgcgggtggggagtggagacgatcataaagaaaccggcaaagtctacaaactattctttgtacacataaactccctgaatcacaataataaccttatgaaaggttttcccctatttttcaggtgagaaaaaccaaggctcagagagaaggacttgcctaaagtcacacagctatgaaatgtccgaactgggattcaaacccacacctgtcagactccagagcctgtgctccttctctccccggcagcctgtctactaagatgttggcccagctccacatacagtcatctgcctcgccagcagcacatttcagaagctccacaatgtctgaggtcgggggtgtcggtgcccaggggcacagctcactcccacaaggccccgggcagggtgagctctgccctcccttccagcagcctctgaccaggaaggccaagtacacggtcagtctctggccagagcctgcgggaacaggacgtcctggtcctcctgccctggtggggcccagcaagctatttttgggcacgtttattgatgggacacgggtgcccagctggactcctgattcaagaggaaggccccaggctggcccagggtggttctgcttctccaggcccttggctgccttgggacagcaaccatctgctacaccccatgtcaagggtgtagcctgagctggctggctccaggaagagcaagggtccccacgagtgtggatagattttgggggggggtcacacagactacaactatttcccaaaattctggagcctgattaattcataggcaggcagaacacagaatgagtatgacaacaggttttgaggttagacttgagttcaaacccccgctgtgtcctctgctagcaaatttaccgtgggcaagccaggccaactcctggaagctccgtttccctgcctgtgaaataataacaatccttactcacggggagggaatgaagcttgaattagatagcccccacagctcaaagcctggcatacagtaagtactcaataatgaataataactttgcaaataatgattgacagctgacatttattgggagtttagcaggtgtgaggcagtgggctaaattattgacattttaaaaaatctcacttcaccccccccaacgattcctgggggaaggtgaatgatgcacttacaggtgccattatcgttcccttttacagataagaaaacagttcacaaagaggaatgatttgcccgatatcacccagcagatgtgtggcagaaaaacccgctggatgcgtggcagaaaaacccgcctttgaactccggccctaagagaggacagggccaggctgcagagctgtgcctcacgccctcctttccctcccacaaggactggttacaaagaccccgtcaacacctaagtccacgccgtatcgtgcacccctcagtcaccccctgtcccagaaggtaacctcctgggccttcctgttgatggaaattcagacaccaacatccctgaatattcccttgacccttcttcctgccattggggttattttgttttcctggttcatcggcaagaaatctgcaagaaactggctgggttggcaaaggctctgggctaacttggaggccgctatgctgtgtatgctggggtgggtgctgggggcctggcgggcaggggagggcagaggctcgcatgccggggcacctcaaggcccaaagtcaatgcagtgtttccttggtaaagtgccctcctggcctgcacctgcttacaattcaacgcagtgccctgagggtacattgcagcctcctttggctgaaagaagcagccttttgtgatctatcctctgcctttgtagccttctttcccaccactggatcccctccaaaaagaacgtgctttgccctgcttccaggcctttggccctgctgtgccctcctcctggaccacctttcctccatggttctcttaccacgtgcttcttctcctggtacttcaggactcctacactgtgaggccctcccagaatccccccagccccctacttggggttgccactgcgacagagggacattgcttccagaactacgttgtactctagactacaaagcccagctggtgagctgacacctccatgtaggtttcacgcaggcccctaacttcacaaagcggaatactccatttatttccctcctgaaaccccagccctgcccacctgtcttcccagctcaggaaacagtgctgccctgttcagaccaggtcctggtggccccttggttcctgtttccctcaccccacacatcccaaatcttgctgacttgactgccaaatacatcccaaatccatgcccttgttgccactttcacagctaccaccgaggtgcaggcttgccactgtccttgcccacctgaaccgtggcagtgagctcctcctccctggtctcctggcttccagctttgctccactcaatccacacagtcagaggaaatatttcaaaagacaaaccagctgggcgcagtggctcacgcctaataccagcactttgggaggccgaggcgggtggatcacctgaggtcaggagttcgagaccagcctggccaacatggcgaaaccccgtctctactaaaaatacaaataattagccaggctttgtggcttgtgcctataatcccagctactcgggaggctaagggaggagaatcgcttgaaccctgaggcgaaggttgcagtgagctgagacggcgccattgcagtccagcctgggccacaagactgaggctccatctcaaaaaaaaaaaaaagaaagaaagaaaaaagaaaaaaaaatctggtttactgctaaatgtttaatgacaccttctcaacaagggggagccctgatttttacatgtatccatttcggtggtgtaaatagtcccaccatggtccatttggagctaccagtgtgacttactgagcatggcattgggaagaacttgttgtactatttccaccgtgggatatggcatatgatatgatacaacacaacagacgtcaatcacttcaacaacacagagaacagtgaaatggtgagaaagtggtgatctgtgagcagttgttacctttgtttttgttgtaacttatttaactggaagttcgtgcaatttaattcttagcgatggctgtgtgtgacaactagcttgcagaattcgtgagccagtaggaggtggtgccagcaaccccactggttgaaagcgacacgagggcaaggatgtttccacattgttcccggccgtttcctggggcctggaacagtagaaggagctcagggtaggtgttcaggccgcatttgttgactattttatagtgcacctgtttgcatcagagagcacaaactgtttgcctcaacttgacttcatgggctgagtccagcccacaagcaggtgtcatttggctctcagaatgttttggacatttttacaaaatttattgccaacgtttaaaagtcaagggttttgttttttttttttatgaaatctcacataaacctagatgtgtagcttctcctggaaaatcagaagctctggacccgactcccttatgacaacagaggctggagcggaggggcgcgcagccagccccttcagactgggcatgggctcgccagtttccgcaggccccacccctacccgcagtctcacaccacgcccacttcattcgttcacgtaacctgctgggcctgcggatatttaagttgcaactgccatcttcgcctccatcttagcacttgtcacagtgtgggcccgtcacagtgtccctgccagacagtgagcaccttggggacaggctctgtgagggagccccccggggtccccactcctggtacatagtaggtccacaggttctggaactagatgaaatgtttgttgtccagtgaatgccagcccccacccagctatccgaattggggcacgcactaaactcaagccccgaccggaatgtgacaaagaggttggccgaggccagggtttaaaaataccccagggctggtcagctgcgaggtgcttggaggtgttgaaacaaccaggccaacgctggctggaggccagtgcacccactttgctctgtgtgatgtgggctaatgggaggggtcactagcaggtcctggcgtgcgggggtggggagtgggaggagtaggtgcagccccctcccccacagccctgcttgggaaaggtcagagatgtttataaacagcatggggtgacatgacataatttcacataaagggttaccaggcagggcatggacacagggcggcctcctctgatgtttccacgccgcggtctcctggcatcaagaaagccgggatgctgctagcactgtggtctccccacggccttcagaaccatggcccagcccgctggagccaggcttaaaaataacgctcccagcacagtctcctgggggacagccagcatgggggctggacagggaaggaacaagctctgctggagcgcccactggatgccaggcacgtcagaggcatgagctcatggagctgcacacaggccttgggagggagggactgtcatccagatggggaaactgaggctcaggagtggtgccactggctcagtgtttcccagcaagtggcaatgctgccatgccaatccatgagacaagagtgacaagaaggcaggctctgtgtcacgccgctgttcccgagtccctggcacagcgtttggccttagcaagcctcaggaggcagctcccatggaacttgtccaggatcgaaacccgctctcccaccacagcttgtctccgtcaagggcagcccatccttccagatgctcagggcggataccagggcatcatcctcaactcctctttttctctcacccccacacctggtgcttgctgctccatccaaacacagccgcccctccctgccctggcccagccccacctctctcacctgacccctgcaggagcctccttcctggtctcctgcttccaccctcaccctaacagtcttgcctccatcagtgtccaaggtaacacactagactcgtatcatccatcacctgaatgtattaggatgcaacagtgaatagaacacacatgtccccgtcagcgtggagctgacattacggaatgggggaggaagggggcatcagccttcacaggtaaattaaatagatcatgtttccaatggcagtgagtactaaggagaaaaataagccggggaaggaggaggggaacatcagagaggaataaatctaaatagggagtgggggtgcagggcaggaaaggtctcactgagcaaatatttgagtacggcttgaaagagatgagggattgggcaatggggatttccagaggaagggcattcttggtagaggaaacagcaagtgcaaaggcccgaggccggaccgtgcctggcatgagcgaggatggcagagaagaggccagtgtggctgcagcagaatgagtgaggggcagcgtgggaggaagtgagttcagaggggtgaagggcagcgcccatagaaccttgcacgtcgaaggaaagacttagctttcctctggggtaggtgagagccatggagggttctgaacagaagagggcacagtctgacttcgtttctgaaagaatctctccagctgggtgtagaggatgggctgtcaggagccagggggaaggggacagtcagggtgactgcagtggttcatgcagaagagaatggtgaatgggcccaaggggtggctgtggaggtgaagaggcggggagaacggatcttggactcctgatctgttctaaggtggagctgctggggcatatgctgctggactagatgcgatcaatagaaatcaagaagccaaggatgtttgggtttctgctaacacaggaacagaaaaccaaacactgcatgttctcacttataagtgggagctgaacgatgagaacacatggacacagggaggggaacaacactggggcctgttgtgggggtggggagggagagcatcatgataaatagcgaatgcttgccgagcttaatagctaggggatgggttgatgggtgcagcaaaccgcgatggcacatgttcacctatgtgacaaacctgcacggcctgcatatgtaccccggaacttaaaatctaaaaataaaagccaaggatggctccaaggttccagatagagcagccggaaggatggagcttctgccttacagagatgaccaagcaccaagctgggctctgggaaggatgggagtgaggcggcggcccttccccggggggcaccggatcctgtgtgaaggtcatcctcaatacagtgggctttgctttatgaaattccctgctgattcacatcaggattcttctccagctcctccttcccatccctgtccctgagtcccttgtaaattttgcaggagccaccaggtccctcctcccctcgattcctgaagagcaacaaacgcttctatagcactcatgtgcctggcaggatcctagccctttacttaaactttgtgaactcatctgatcatcacagcagttccaggagctggggactcttattacacttatttcataaatggagaaaaaaggcccagagaggttaagtcacttgtccaggatcacacagctccaagtggtagaggcaggatatgatcccaggcagtcaggcctaggcctcatgctgttaaccactacacttactatctcacccttggctatgaggagtcaaactgggcttgagagattgggtgaggggagagggcttcagccaccccttccacataaaagaaacagttgccgttttctgagtacctctcctgtgcctagttctatacccaggcttcctctattctgcatatcaacagaaggggtatcacaaggattgtacccattctacagataagaaaaccaaggctcagagaggggaaaagccatgtccacagttacagccaggactgagaatgtggaactctgggactccagaccccattctgtcccctcctccacactgcctgtgcttgtcacccgcttcctgccttggtggtgaggggggtgctcaggggtcaatggccgcactgcattttcttcttgctggaagcagaaggaggacaggagaagtgacacattgcacagctgcacggattcccgctctcagggctcgtagattttgtctggcacaatcaacatgtctgaggccagctctgggccaggtgctggagagaccgagataggaacacagagtggagggtgagaaagatggaggccctaggtggctttgatgagatagacagtggtggggttgttacagaagttcagagaagccgctcagaggagcaggtgcacatgaaccttgtgtcctggcagcttcttcacttctctggatctcagtttccatctctgtgacacggggtggtcatacctgccaccccatctcacagagctggtcaggactaaaggtgagcgccaagggggcatgcactatctccaccttgccctctgctgtcttccaggacagaaagagcacaggccccagcttgttgtaggcattctggggacctggcacacaggaggtgctcagggcctgctggacgtatggaaataaagaaataaacttctttgggacttattttcttcccccataaagtgaattatttccatgcacccatgcactttacaaagacatagaccctctcaaccacctggcaaggcgagtactaagatcatctttgcttaacaggtaagaaaaacggacacctagagaagctacgagatttcaccaaggtcctagagctaagaagggatggagctagcatttgaatttcactccctctgcctcctcagcattcacagaactaattgcagaactaaactaataacagcttgtgttttgtggagcatttattacatgccatgcgttattccagacacttcacatatattaactaatattagtatctacctcaaatgtgtgggagagatgatatttccttcccattttacccataaagaaagaggttaaggggcaggagcagtggcttaggcttgtagtcccagcactttgggaggccaggtgttcgagaccagcctggggaacatagcaagacccccatctctacaaaaaacaaaaaattagctgggtgtgctggatcatacctatagtcccagctgcttgggacgctgaagtgggaggattgcttgagcccaggaggtcaaggctgcagtgagctgtgattgtgccactgcattccagccttgtctcaaagtaaaatttaaaaaaaagaaagaggttggccaggtgcggtggctcatgcctataatcccagtactttgggaggccaaggcaggtggatcacctgagatcaggagttcaagaccagcctgaccaaccaacatggcaaaatcctgtctctactaaaaatacaaaaattagctgggcatggtggcaggcttctgtagtcccagctactcgggaggctgaggcaggagaatcacttgaacccgggaggcggaggttgcagtgagctgagattgtgccactgcactctagcatgggcgacagagcaagactcagtctcaaaaaagaaaaaaaaaaagtaaataaataaataaataaatgaaaaagaaaaaagaaagaggttaagtaacttgtgcaaagtcacaagtaatttgcaaagccaggattcaaactcaggcagtctggctccagagtccatggtcttaaatcacaacaccctgcaggagagggttggcaatgtcatcccaggcacagagtctggcacacggggagcacttattggattgtgaaaacctagcaaaccacgaacagacaagcagggctttcctattctgaaccacactgaggtctcccttaagaattcacttatttccatttcttcctgtgagtcccacttgacagagaagaagctgcccacagaccattttcccccttcttccccctccctctaggaaaattctgggcagcatccaccaggtcacagctgccagccagaggactggctagagcagagtttggccaggttatcgggtttcgtggtcagccaccttcgcccctgaccagagctgtctttccaaaacagaacattcagtcactgcctgtccctgcgcccagctgtccttgtgccccgaccttgctctctgcccaccggcccagggtttttcctcgtattcttgtctcttactgatatcttgcaaagatgaccggagcagaggaaagaaagtcagggagcagcctgagagaaacgatgaggagacagagacagagaaagaagagacagagaaagaggtgacagatggacagaggagaaagaggagacaagaaagacagagaaagaggagacagaggcgacagacggacagagaaagacagagaaagaagagacagaaagacagagaaagaggagacagagatggagagacagagctggagagaaagacagagacaggagggccctgcaggtgccatctgccctccaaagctgtctcgagggcagggtttgtaaccttgcatctccacccaatgcatcttgacctcccaaggctgcagcatcttctcccaacagcccccatcctgccaccagcccagcaggtcctaagagacctcgttttccttcccccctcacctccatgcacaatccctcacctaactaactcctccttatctcccttcctccaggaagccctccttgcccccacagcccctctatgtaccctgattacacctccctcatactttgtggttcattgataggttcgcctcctccactggaatggcagctcctcgagggcagggtctggatcggtctggctcgccctgcatccctgcactcagcccagtgcctgactcatagtaggtgctcaataaatgttggttgaaggaaggattaagccagctgctatgtgtcagctccttggagaatccttccctggtatggcttacaactgtttggacttcatcgtgtgattatttgatttagggtctgcgtggcctctggtccgaagaaggcaggatctgagtctgctgcattcacccttgtcttcccagcacctggaacagtgcctggcacagagtaggtgcttcagtattggttgaatgaatgaatggatgcatgagcaaatgaattaaccattagccctctggaggttttgaatcatattttttaacccatttgaagcagttcaaatgttccccattgcctttcaaatcagaccccaagtcctgtcaagacctaggaggctctgcaagatctggcccctgccacgtctccagcctctgcccttctcccgccacccctacaggcaccgatgtctctagggtgcccggcgtggtagcagttctcatccccctccacaccccaccataagtcatgtcaacagagctgggttggtttatttgtttttttctatgaacaagactgcctagaaaaatggagcacttttgcacaaacaacctcaatgtcacccatggaccttggtcactgtgggacagtctccaaggtttggccggccagcttcccagggcactgacctgagaaagggtttgcgccctggtcgctccgtccatctcccacccgaccctctaaagggctggctggctgggtgggaggggtgtccttggagcccctgagtctgaccttcatgttctgcaggaagccaggggaggggacccaatggagtggaccccaccacatcctttaggctcagaccaggccttacaccctccagaaagctgccttggccactttcctggcatctctggactcctgttctcaccctaattgcatctcatatcatgcttggctgaaattctctactggacagtttcttccactggactgtgctccaagtgcttaaggccaagtcttttctatcttggtgtccccagagcccagatctggcctatgagggtcatcagcaaacatgcagtgaatgaacaaaggattattgaacaagcgcttcctgccttagtgcatgctgacctctgtctttcttactaggatggggtcccaaggaccttgtctcttttatctttgctcctcagtgtctaacactgcttgacacatcagtggcaccatgaaacatgtgtggaataaacaaacaaggccttcctaccatccatcatatctgcctctcctcctggactgggagcactatgaggtcaaggaccaagccttatttatttctagctcctctgagtctagcactggacctggtacaaaagagatgcttggtaggtacttactggatggatggatggatggatggatggatggatggatggatggatggagttgaaactgatggatcaatggaggaatgaatggaaggttggacagagtaaatgaatagaatgggcggatggaagtgcaggtgggtggatggatggcagatgggtgaatgaaaggctggatagataaatactacagtccaggtcgtgaacgtgggaaatattgctttctaccccccccacacaaaagccaccattttagaagagctaaaatcattttagaacagctaaaatgaggccagagaatgactcagctagagtttctatgagagatatttaaaagaaaaaaaaatgtgagaaagacgggtctcggaggctctgaacttcttaagcaaaaccctgtaagttggccgtgctctcttgcagcgtttatgtgatattttatggagggcctgccatatttagtgcccttgggtttggtctggaagttgaacgaaatttcagatgtggaccctgaccccaggttgctcagagtcagatatatgcccattcatcctcaatgcgtcttcttgtcggggtgtccaaagaacaaaggtttgggaaacaaacacagatttgtatcctgacttcttttctgtgtgacctcaagcaagtatcttggcttctctgaaccctggtttgctcatcctgctttgcagggttgttgcaatcacacaacaagcccatgcttatcaaatgctgagcccaggctgggattgctgttgatgattggtaaacactaaactgggcctcagtgtgcgaagctgctgacttgctgtgtgatgttgtcggaatgtcgggacttttctgttccttcatttcagctcagtggcattcatccttaacaagggccgtgaactaaagaagagctcaagctggggaacccagtagacctgggtttgggatcctttgctccccggctgcatggtttcagacaagccaccgtgtctgtctgaacctcagttcctgcatctacactgcagacctccttgctgtttctcaagcacagctgtcacccctgcacccaagctctcctttggcaagagagccatagaaagtgagttcctggcatccaccttggggacgtgtgggcttctaaatgcggtgcaccttgaggcactccagagcaaagaggggtgcagagggatctggaagggcaaacagaagacacctgtcttctcaccctgtctggaagaggacccccattccatgtggtcccactagcctactgatttatgttgccaatagtttataccacatggctttatagaacatgtttattcagcggggcacggtggctcgcacgtggaatcccagcactttgggaggccggggcagatcgcttgaggccgggagtttgagaccagcctgggcaacgtggtgaaaccccatcactactcaaattacaaaaattagccaggcatggtggcacatacctgtaatcccagctactcaggaggctgaggcaggagaattgcttgaacccaggaggtggaggttgcagtgagccgagatcgtgccgctgtaccccagcctgggtgacagagtgagaccctgtctcaaaacaacaacaacaaaagaacgtgtgtattcatttatttttcctagtctaactccccacctgatactcctgtccgctccatgagaggagagtttctgtgcattttttttttttgagatggagtctcactctgtcactcaggctggagtgcaatggcacggtctctgctcactgcaatctccgcctccagggttcaagtgattctccagcctcagcctcccaagtacctgggaccacaggcacgtgccactacacctggctaatttttgtatttttagtagagatggggtttcaccatgttggccaggctggtctcgaactcctgacctgttaatctgccccccctcggcctcccgaagtgctgagattacaggcgtgagccaccgcgcccggtctacgtttctgtatgtcttgattgctttttcatcctcgggttctaaagcctagacaggcacatggtctttgttaagtaaatgtgttgaataaatgcatgtatgaatggattagcacataaagaaatgaatgcatgaatggataggtgcatgaatagctgggcccaacagaatcagttaagaggcttaaccacacacacactcacacacacacacagacacaagcacacgcacacacaaacacacacacctacatacacatacagaggtgcttgagccctgctccaaaaataaaaataagaatcaacccttaatgatcacttactcattaagtataccaggcgccacgtttagcctgtgatgtagggcatttcactgaatcctcatgaccaccctctgcggtagggactaatgctatacttttttcatatgtcaaccctgaggctcagagaggtaaagtcactgaccccaggtcacacagccaagaggtggaggagccaaaattgaattcaagatctatttgattccagaaccatgcctgaccttactgggccagcggggtcacctctgaatcaagatttttaggattccccaggtgattctgatgcacagccaggttgagaactcctgggccagagcattgaggtttgggggagtctgctggctttgggaccagctgatccagcccctgtgctgcctcgcagcctggttccttatctctgacacaggcgtgatggcagcgcctacctcaggggatttcaggaggacctaatgaattaatccacacaacgtgttaagcagaacacagtaagcacttctcacagctcccctgggtgcagacagatgcattcccaacctcctagtgcagtgcctgggacaagctggaaagggcatctcagcagcattcgagaggctatcgcatctaagagtgaacgggaatgctatagtaattccatcccccagaaaaacatcttgcagaaatactcgcacacgtccacagagttgtgtgccctacagaccacgacagtgtggcttgtgatagcaaaagccaggaagcaggcccaatagacatgtttagggcagggctctccacttcagcaaggtggacgtttggggtcacataattccctgttgtgggggctgtcctgggcgttgtgggatgtttagcagaatccctggcttctaccatctagatgccagcagcatgtcactactccaagttgtgatgacagaatatgtctccaaaatcgctgaatgtccccagcattgctgaatgtcccctggaggaaaaaaaaaaaatcaccccatccaagtggagaagtttgtgacatgcccaaggagatggaactcatatttcagcaaagctgtgactttatcctgcactaagtcccaggtcacacttttcctatttgctttttgtggattccttagactttgctccattcacaatcatgtgttctatgactagagataatttcatttcttcttttcccatctggctgccttggcacgtttgaggacagaacttgcacaacacaaattgtagctcaagtggattatgtaatctgcacagggatgctttttcgggaagttaactttgttcaaatattgaaaattcgtaaaatagaagaatatgaatttttttaatgggaccacccacagagggcaattttctcacagtttgctcgtctgagtagctttctccattttgaaattttattataaagttgcaatcacactgtatgtacaatttcaaatcctgttagtctcaaagtcttcaaaatcatacttctcgtgttattacaaaattttctttgacgttctctttaattgttgtctattgtttctctcttatcctctgatcttctctaatccttaataatgaaaattgcaggctgagcatggtggctcacgcctgtaatcccagcactttgggaggctgaggtgagcggatcacctgaggtcaggagttcaagaccagcctggccaacatggagaagccctgtctctacaaaaaatacaaaaaaagccagatgtggtggtgcatgcctataatcccaggtactcaagaagctgaggcaggagaatcgcttgaacccaggaattggaggttgtggtgagccaagatggcaccattgcactcctgcctaggcaacaagaatgaaactccatctctgaaaaaataaataaataatggaaattgcaagctttcgctgggcacgtgaccacccagaagaaaatctacacttcccagcctctcttgcagctaggtgtccatgtggccaatgggatataagtaacgtctaagtaatgtctgtgggaaggggtgcctctactttgtcccatcctccttgctggctggagtgcagatgtgatggccggaacctgagtggccatcttgggacaaggcggagcaatgagagaaaaggacgctgagtccccagtgaatttgtacagccaccctactagtcctagactgccacctccacgcatcttttaggtaagaagcaaatttctggctgggcgtggtggctcatgcctgtaattccagcactttgggaggccgaggtgggcagatcacgaggttaggattttgagaccagcctgaccaacatggtgaaaccccgtctctactaaaaatacaaaaattagctgggcgtggtggcaggcgcctgtattcccagctactcgggagcctgaggcaggagaatcacttgaacccctggaggcagaggttgcagtgagctgcgatcctgccgttgtactccagcctgggcgacagagcaagactccatctcaaaaaaaataaaaaaaatttcatttgagcccctgttattctggcttttctaacattcaaaggtgaacctaatcctaagtattacactaatattttgtgcagaaggtgtctctaacatccttttaggaaacatttcctgattaacttaaacattccctgcttattgggcatttaagtagattctgattcctcactattcttgtcaattcttttttttttttttttttttgagatggagtctcactctgctgcccaggctgcagtatagcagtatgatctcggctcactgcaatctgtgcctcctgggttcaagcgattctcctgcctcagcctccggagtagccggtattacaggcgcctgccaccatgcctggctaatttttgtatttttagtggagacaaggtttcaccatgttggccgagctggtctcgaactcctggcttcaagtgatctgcccaccttggcctcccaaagtgctgggattacaggcgtgagccaccacgcccagccttactcttgtcaattctgtcgtgaatgtctttgtccactgtcactattcatgattatttccttagtacagaatcccagaagaagggtttgggggtcaaagaacatgaacattcttaaagctgtcagtgcctgtcacccaactgccttccaaaatggttcagctgacataatgccctcctcctccagcaggggatgtgaggacccattttgggaccagggtaaagatgacaacattccacatcattccctccagcagctgaaaatgagtccgagatagtcatttttggatagttcttaaatacaacatatggatgagcagtcattaaccacgaagcttaggagacctagtgtgatctagtgtcaatctgggtttcttagttgcgagggacagaatgcacccctctggctagtttacacagaaaaggagtttatcaaaggttattaggtggttcataggaccctcaggggagttcctgagtcaggactgggggcaacacagctaggaatgaggctggaatttgatggagagctgccccagtgagccccacttctactcaaggacgcccccactgcatcctccagacccaggttctctttcccacctcttttgtcctgttgttctcttttaattggaagcctctcacaggggagcccacttcacactcccgcacccgggaggctcagggaggctaggaaagcaagttttctggcaattcctttgagagatgtgatctactaaggtaggaaattccctgaagggtgaccgcagggtgtgggccagaaagtagggcaaaggtcagctccttcggcaaagacggctgggcttgtgggaagaatccaaaaaggtttctagcaacaccttctccatttctcctccactgagggcaagagaacagcagagagaagtaaatgacaaaagtgtcattcccatttgtgtcacccttggggttcacccaactctgcagaggctaagttagagtggggaccttgagatctgtcctcgcttcaccaacctgaggccagcaagccaacgcggatgtctctatctgatggatgtgtgtctcctggacccctgaccacatccttcaaggagacgtttgtgaaggatgtgtttgccttgtccactgttgcactgaacaacaccagcatccggacaagccctggcacacagtaggtgctcaatagataaatctcgaatgaataaatgatggcactggactctctgccttggaagaaaccttggagtctagagttaccatggattgactcaaccagtatttcctgagcacctaccatgctccaggccctattttaggtgctgcggatactgcaggaaagaaaagaaagtcccagtccctgtcttcagagtgaaggagatgggcaatccattttaaaacgccaaaaatattcatataacacagcacaacacaacataacatcatataatctgatctaatacaataccaagtaaaatgttttacaaggaaatgtaaaactggataagtgatttggagatgctcatttagaaaaataattgaggaaggcctctctgagaaggtgatgttcaagcagagatctgcggtaggaagggagtgagctgagcaaatatgggagggaagtgtattctgggcagagagagcagccggcacaaaggccctgaggcaggaatgaatgagcttggcgtgtgccctttgtggtgaggcggtcagtgaggcaagggttacaccaagtttcccaacttcagcaaatctacagaacccttaactggcggaaacaggaggtagggagggatgagttcttcactcttaagcttctctgggaaaacatgatgtcagggacagacagtaaatcttgacttgtcccagaaaacaatgggcccatgtaaccagtgaagtgttagcctgaaagtaaccggccaaagggctggggtgtgggtgggtcatatggaatttgttaacagatctgcattagaaaaagagcttcccagttgggggcagcagaagcttctggctaacatcaaaaagatgtttattgtggtgattctgtgcagacatgaaaaatggagattcgccacacagagatgtggaaagatgtccccaatacgttaagtgaaaaaataggccacaggatagtattatatattgtacaatcccttttgaaaattcactagtcatttattcagaaaatattcattatggacctaatgtggtgtggaagacccagacgcggtcttgcctgcctcctggaactgaccgcacagtggggaaggcagatgacgatcagatcagtacacaaacatatcatccaaacctttgatcagcactaaggaaagatacctggtgctaccagaatgtgcacacacatcaagtgatggaaaaagcctgcgaggatgtgctccaaaatgtcaaagtggtagtaaggtttcaggagattccactttccttttttgtttgttttttgggatggggtcttactctgtcacccaggctggagtgcagtggcatgatcatggctcactgcagcctcgacctcctgggctcaagccatcctcccaccttagcctcccgagtagctgggaccacaggcgtgcaccagcacacccggctaacttctttttttctttttttaattttgtagagatgaaggtcttgctatgttgaccaggctgatcttgaactcctgggatcaagtaatcctcctgtttcagcctctcaaagtgctgggattacaggcatgcgttaccacacctggcttgattccacttttcttatgctcctctttcttttgattgtctgtaggttctgattttttaaaataaatgtcatgatttataatcgagtgaataaaaaaaaaactcaaaatgaataggagcaggagagctggaactcacgggtctgcagaggacttagacccagggaaggaagaatacacaagaaaccaatcaacagaggctggagtaggaggtatcctcacttctccctggataccttttgaaccttttgaatatgtaagtattcaaataatagtaataagcaaaggtattttaaaatgaaactttgagtcaagttttattttcgtgaaaaatgaaaaaacagacaacagtaggatctcaatttaaatacgcgagctgagctgaattcccgtgcacatcttagagtggttctctctgggtcacctttttagttttcttctttgtacttttctgtgtctcctatatttaaaataagaagaataaaaaaagacgagaaaaaaagactaccgaatatagaccatttaccacgggcaagatcccattctgggtgctttacaaacatgcttttgcttcatccccatgaccttctcattccttactttcatttgacagatgaggaaactgaggctcagagcacaaagtcaccggccagggtcacccggccggatttgacccgcgttgatcagatcctaaagtctgtctctaaactagaaagctcaagtacccttggtatgtccttcaaggaaacgactttgctttgaaaatcagggggaaaaaataaacaaaccaaacaagaaatatgacatttttttaaaccacttatttaagctctgatgggacctgagaccagccgagcttggggagggtttctcggcagggcactgtttgtgttgtgggtggggctgtcctgcctggcagtcccccatggcacatccctgcctgctcgtcagccatgttcccctgtcactgtgacactcagatcccccatctctgccagcctcccctccttgaagactgctggcctagacactgcagtgacactgaattcctgctggggcctcgctcctgttgtcctgtgagccactgtgggttgacaccccctgcagacctgagaagcaggtgcctcaatggctttgttttacaaggagactcagagagggctgggtgacttgtcacacagccaagacttggccccatgcaatactgcctaccctctgggaccaagtcttttgtggttgtggggtcgaagcaggggaagggaaaggcgagtggcctgcagccccaggctcagagggaaggcagccacaaagcgcggtccactctccagccagctgagctaggccgggagaagtgaagctttgctgccaggctgggtaggccaggccgggcggcgggcaggcggccactacagtggggaccgggaagtcgagcactccctctcgcctgcccggcagtgtcccatggccgcccgccaggccccgcctgacgtcagggtctgaccagggacataatgtgctggcgtggggacaagggctgactgcagagagacagagccgcaaggcggggcggccaggggaggcgggcaggcagaggaggagagagagaaagggagagagagaaacaggcagagtgagagagagagagcgagagacaggggatgggaaagagaaacacaaacagatggagagagaaggaaacagagggagggagagagaccgagaaagtgaaaaagagaaacagacagaaaagagacacagagaaggagaaaaacacaactaggaagatgttcagggaaagctggagagacagcaagagccagagagacagcaagagccagagagaggaaagtggaggtgctgggggggaaatgacagagagaggaggcctagcaggggctgtgcggttaagggcaggtgcttgggagaccccagacctgggctggggctttgactctgcccctgtgagctgttgactcacctctgagagcctccactccttacctggtgcaatgggagtctgagtaacagggcttcgctcatctggggaggggacagagcccctttccatgatgcgagagggagaacaggagtcagatctgtgtaaagtactttggcagagccctgcatgtagtaagtgctcaataaattggaggtgaaaattgagaaagagttgggaagtgggaaatggaatgccagagtgtgagtggatgggggtcgcccccatggacagaaactctcgctccacagcactcccttccctgtagccttggaacaacccccttcctgtccctgcatggcttcagcttgaggccaccagcacagaccttggcctggccttgcctgtcttggggcccaaccccctgcttatgggttcaagaaggccatgatcccaaggccatcgcgtcaccaaagccaagcaaggccagaccctggtcacttctggctttccagcctcgtcacccctcagccgcttaattgttaaatggcctggcagggctgagggactgagccagccgcctgtctgggtgggggcagccgttcccgcatgtcctccattagtgcaggggcacacacgccagaggcctcaggtagcacttgctgaggtgaggatgcaaagatccctttctctagctcccactattcccagaagccttcatcagcctcagcctcggcctcaaattctcactgtgtgccaggcatgcttctgagcgcttcacaggattaatctacttaatcctcctgacagccccaagagatgaagtgctaacattatctcattttacagatgaagacgctgaggctcagagagctggagtcactggtccaagcccacctgctaaggagtggcagggccaggcagccacttaaccacagagcagctacgattccctgcacaacttgagcagcagcctgtgccgggtggcaacacaagcgcccggatcatctgaccagggagcagtccttggctgggagtgattttgcccccacaggagatattaggctatatgtggggacatttggggttgtcacaactggagagaagttactggcatctgatgggtggaggccagggatgctgttcagtgccctacagtgcacaagacaacccccatagcagagaattatccagctccaaatgtcagtagcaccaaagttaagaaccttctataaggtaaattctattacaatctccatgttataaatgtggaaactgaggcacagagagagggtgggactataaggtaagttctgttacaatctccatgttatagatgtggaaactgaggcacagagagagggtgccacttgcacaagaagcccacttcatgccctgctcttccataagaccccactgccaatctgcattaagacacccctgcctccattcgaggccttctgagtcctcacttgctcagtacagacaatgcttcgcatcctctcaatatatgaaggtcatcttagtcattgacagaaaaaaaagatcaagccacaaagtcactgggaatgtacgaatgccttaaaatgaatttatattttattcatggcagcattgagggacatttgaaataaaccaaatatggattcatggagcaagtattttctgagcacctactaagtgccaggccctgtccatggtgctggagatacagccgagaaccagacagatccagcccctcctgggtctttaggaggtgacagtctggtggggaaggcagatgatagacaagaaaacaaacacacaaccaaggtcacttttgactgtgtgaaatgcaactgtggggcaggagaagggccgttctagggagggtgatgtccaacagggcctctctgagaagatgagacccaaaggaagagaaaggtccagtcttaggaagaggcaggaatgaaaagttccaggcaacagagcacgtgcagtggctcacatctgtaatcccaacactttgggaggctgaggcaggtggatcacctgaggtcaggagttcgagaccagcctggccaacatggtgaaatcccctctctactaaaaatacaaaaattagccaggcgtggtggcgcacacttgtaatcccagctacttgggaggttgaagcaggagaattgcttgaacctgggaggcagaggttgcagtgagctgagattgtgccactgcactccagcctgggtgacacttctgagcttctgagcactttttttttgagacggagcaaagctccgtctcaaaaaaaagaaagaaaggaaaaggaaaggaaaggaaaggggatggaagggaggggggaggagaggagaggagaagaaagggaaaaggggaaaggaaaggggaaaggaaaggggaacaggaaagggaagagaacaagaagagaagagaaaaaagaaaagagaagaaaagaaaagaagacctggcacggtggctcacgcctgtaatcccagcactttgggaggccgaggcaggcggatcacaaggtcaggagtttgagaccagcctggccaacatagtgaaacccatctctactaaaaatacaaaaattagccgggcgtggtggcgggcgcctgtagtcccagctactcgggaggctgaggcagtagaatcgcttgaacccgggaggcagaggttgcagtgagccgagatcacaccactgcactccagcctgggcaacagagcaagactctgtctcaaaaagaaaaaagaaaaagaaaagaaaagaaatgaaatgaaaagtcccaggtatagggaacagcatgtgccaaggctctgacgcaagtgtttgcctggagtgttgaagtacaagcaggaggccagtgactggagccaagtgaggcaggagagaagaagatgagatggggaagtcacaagtgaagagatgtgtgataccatgtgaccactataagggctttgcatgtaggaggtgggagccatagcaaggttttgaggaggaggcacagggtctgattcaggttctattaggatcatcttgaatgctttggttagctgaatagtggccttccaaagatgttcatgtcttaattccccgaatctgtgagtgttactttatgtggcaaaaggaacttggcagctgtgattcagtgaaggctctgaagatgggaggattatcttggatcacccaggtggggccaattaatcacaggagtccttataccacgaggcagatggagacctgcctacagaggaggagaaggcaaagaggagagagaatgacagaaacagagactgcagtgatgtgctttgagagtggagggtggggccataagccaagggccatgagcatccactagaagctgaaacagacaaggagacagattctctcctggagcctccagaaggaagtggtcccaccaacacttcgacttctcacctccagaactttaagaggataaatatgtgttgttttcagccactaagttagtggtcatttgttttggcgacaagaggaactgagtgtgatgcagtggggaggatagactgtaggagggtgagggtgggagcaggaggacccatgtggagaggctactgcgattgtccaggcaggaaagaatggcagatgaagagaagcggatgcctcactcggccatcgctgggctggtgcctaggacacggagctggccactgcatggttcttgttttgaagaagactccagctagaagaggctcaagaacagttctgggaaatgggaaggatgggcttagctgggctagaacctcatgtcggtcaggtctctgtcccagtgtcccctgcagggtggtgtcctgaccatcccggccccgggaaccctcccagggctcccgctccctcactcagcttcagtttgctgtgtgtgtcccatcatcatcccgtgtgctacacctctgtctgtttctccattgtctggacccaaatgaggaaggactttgcctatcctgctcactgcgcatctccagcacccagaaacggcctggcacaaagatgtgctcagcacatacgtattgggtgaatgaaccaacaaatgaacccccattttccaaccaggaaaatggttgaaaactataccaggaaggtgacttactcagcaccacacagtggctaactacagatccaggatttgaacccagaacggactccaaagtttgcactaagtagcctacttccttgtaacaccaatgacactgcctgtgttccagaaattcctactttgtgggagtagtgctgtatccttcttgaggggtcagacactcgaaacacagcacctcggggaacctacaggacaactgacctgctcgaggctattattagatgaggaaaccgaggttcagaggggttggggtcttccctgaggtgcacagccagccggcggcagagcctagagctgggactcaacccttgttggatcccatagctgggggtctctctcatattttccaccttgctctgggtcccagagaaataagaaagactctcctgccctaagaggcagagtaggtgtagatcacactgcccaatgtccgggctgagcctggaggaagcccagcaacacctcaagctggaaacttctgaaaaatgaggctggggggttaggatctagggccctggggtgaaaccccagctttgcccctcccctgctgtgtggcctcaagcaagtgatctcctctctctggcccaggtctcctctaataactccaaccaaaattctggacagagttgataaagccctatagactacattttaaaatcaaaacacccagccgggcctggtggctcacgcctgtaatcccagcactttgggtggctgaggtgggcagatcacctgaggccaggagtttgaggccagcctggccaacatggcaaaaccccatctctactaaaaatacagaaactagccaggtgtggtggcgggtgcttgtaatcccagctacttgggaggctgaggcaggagaatcacttgaacccaggacgcagaggttgcagtgagccaaaatcgcaccattgtgctccagtctgggcgacaaagcgagactccacctcaaaaaattaataaataataataaaataaataaacaaaaaagtaataaataaataaaaatacaaataaattttaaaaattaaaagacccagtgtgtattctagctgacattttatatcagattgtactgcctggggacatacaaatgtagtcataataaaatgtagtaaaccaaatttggaaaaaattaagaaataaaagaggagtttcttttcctctcatgtgaatgaagtccagatgtaggcagtttgggatggatttggtaactctatgaagctctcagtatctcagcttcttcctggacaccagtctgccatctctaggtgtgggccccactttctcatgatccaagatgaaggccactgcaccggccttcacgtctgccttccagaatgacaggatggagaaggaaggatgatgagtaaaaggcaggcatcaactaaatctctaggaaacagtccagaaacctgtcacactactaatttcaaccccttggccagagctcaggcacatggctgcacctagctgcaagggaagctaggaaggtctgtgtttattctgcacagccatgaactcagctaaaagccaatcaaatatttgtaaataaacaaaacaattttagatagtgatgtatcctgggaaagaacaaaacagggtaatctcttggacaatgagggtgggaaaatgcctccctcaggaggcagcacagctgagatataaatgataataaggcctgagggacaagcattccaaacacgaggaacagaaaagcaagctgccttgaggcagaaacaagcctggtattgtaaagaaacagaaaggccagcatggctggaactgggacagggatgcagtgggaggcgggcacagctggtaggaaaggaggtcagagagttcagcaggttagatcctgggagaaacgggaaggccaagggaaaaatctggattttttttttctcctctaagtacagtgaggcaatattagagggttgggctgatatgctatcactaatggagagaatgccgagctcccctggctcctggaggatttgccataacccttctgagcacttcattcactcaccaattcattcctctcataaatattcattgctgacctgctctgtgccaggtactgacttacggcagcagaaatgactcctccagtccccaccctcaggaaaagaagagacagactgagcaaacacaaaagcctataaatacagctcccagatggctgccagtggtttggagggaaggtaaatggggccacaagaggacctgagttcacctggggatgggagggggtttcccactggtggtgatgtttgagctgaaattggaatgataaggacactttgtcttgtggtctggagacggagagaacattccaggtagagggaacagtttgtgcaaagggctggaggcaggaagagagctgcatatatccagaaactcaccaggctctggcctggcaagagttgagaagggtgagagagaaggtgtctcaagatggccctggagaggtgagcagaagtcagatcacagaaagcctggaaggggccaggcgtggggtctcacgcctataatcccagcactttgggaggccgaggtgggcgaatcacttgagatcaggagttcaaggccagactggctaacatggtgaaacctcgtgtccactaaaaatacaaaaattagctaagtgtggtggcacatgcctataatcccagacacttgggaggctgaggcaggagaattgtttgaacccaggatggggaggctgcagtgagccgagatcacgccactgcactccagcctgggcgacacagacagactccatctctaaataaataaataaataaataaataaataaataaatgaaagtctggaaggagggtggggctctcgtgttctgggaggatgatttatgaagaactttgaccccaaatccctgggaggggcctgtggccaatcccagacaagcagggcctggctctccttggacagtgtttacaagctcgctgatgactcggccttctgccttcctgcggtttgctaatcactgggtgctatgtgccgggatgttctcctgctcctcagccctgagagcacactctgactcatgcctcctaccccagccaccccctcccatcaccaccaaggctgccatctccccccgtgacccccaaggccccacagaatcacacgaccctggcaccaggaagtgcacctgtgtctccaatcagaactgcccatttcacagaggaagaaactaaggtcccatgagaaaagcctttccccaagtctcaccccaagacaggaatagcaccagggcccggtcccaggtctcctaacacctggtcctaatttttcccactgtttaatgacagaagagagaaaatgagaagaaaggaagcaggaagaggtggaggagaaagcaaggagggagtgaggagagggagggaaggggagctggaaaagcagtgttcaaatccccaactcctaagtgagccctgggaggggaggggagaggattcgtgtttgttgggcacccactacacgccaggtgcctcgactgtgtcagctccttcagcagaatcctcacaggagaatggatacaattacttactctaaatgctttggaaaacagagaagctgtgcaacccatctaccatcacacagcagttacctggcagagaggagaatggaacccaggtctggctgcaattcctaaccctaagcacactccaggccccaggctgcctccagcccagcctctgctccgctcctctttttgaggcagttgcagcctccacttccagagccgatcagcagaggctttcccccggctgcccacaagccagcagacggatttcctttggcccacagggcattttaattaaatttgagctaatgttcataaatcaagagatttcacataaaaattcagatttctacctcccttaaaacactgtaagatttcactgggctaaatccacattcccacctggcaaccgtcagctggggacaggggtatttgaagtggacacaccagttcccccacactccccaactctccctgctgcctccctggtcctgaggctgaatgtcgggtgccattcatcaaaatgcatacactgttgttttctgagagcagggacgtatttctctgtaactgtatctctttcaaaaagaagaaaacaagtgctaatccaaaaggggtcaagtttcatgaaaaatgggggaatgtctaattctttgcggaaccaagagatactccttcatgcttattatgcagacgaagtgtgcctgagccctcacaccactgcttagcttcctaaaatatttttttttgtgtgtatctgaaattctaatttaactgggcatcctgtattttatctggtaaccctctctagactagtcaccttgctgggtgagtgatcttgattgagcaagtcatttaagttttctgggtttcaggttgttcctcatagacagggttaataacagcatgagaggttgaggtaggaggatcctttgaggccaggagtttgagaccaacctgggcaacatagcgagattccccatctctacaaaaaaaaaaattttttttttttttttttaattagccaggtgtggtggctcattcctataatcctagctacaggggaggctgaggcaggaggattgcttgagcctaggagtttaaggctgcagcgagctgggattacaccactgcagtccagcctgggtaacacagcaagaccctgtctctaaataataataaataacaagaggacctgatgagatattacacattaagagcttaggacagagcctggctcactgtacatgctcagtaaacgtcagctgctggggcagatgacaccagctgcttgcccaacacccattcccttgttcctcactaactgaaccctggttaatggcagccatagtgcctggccccaggggatgaatgtgattggtctagtcaagcatgccacacccattccaagctgccagtgattggaccaaggtgagcatgtgacctgactctagccaatgaggtacaacaagaagtcagcggggatgagtgctccagggagactttctctccctaaggagttggcactactgccgctgttcctccctttttgttttggacacatccattgggaaaaagggatacaggatcccagcccccatcttaagacagtgagcatggccaaggtctaggctggaggactcctgggctgacaatgccaaacttcgttttaagtaaatgatggatgtcgttatggccgaagccatttgctaattggctctatattagccgaagctaattggctctatactgtggcagcccagttatgttactgactagctctgtgcctcagtttccctatatggagaatggagggaacgatagtatccgctacatagggttgttgtaaagttattcaatgagttagcgtaaatgaagtgctaattactctacctggcaagttatactcaccatataattgttagtcattataattcttctgttatttgcatccaagtctttctaaactgatacagtcaaaaattccctgaaagctgtgaattctgaagtttgataatacatcaaagaatccaagccccaaaatataagcaaatgtgcctgtttaaggtgagtcaatgtcaaagattcattcaagaagtttccttatatttcattcaccctgcaaaggatctaagcagattcaacaggctgttcgtcagctcccaagaaggggaggtgggagatgggcgtgtcagccaatcctagaaataagagatagtcccatcatttggaattttgggtagaaactgcaggaccaaaatatggtagcctgagcataagtgtattagttagcaatgccttctgctgaaagcttcagaatgccccagtcacagtgggctaaacagtaaaggcattctattatttcgcagacaacactttgaaagttgatggcttcagggtcaaaaaagcatctcagcaatgtcattcagcatccagctactttcagccttcatatttagccattctgtgttggctttttatcattagccttgtggccccacagtaacaatatagttgccacagccccaagcatcacatcccttaatgaagttcaagataggagtgttgggtggtgagttaaaaagaaaacaatctcggccaggcgcagtggcttacgcctgtaatcccagcactttgggaggctgaggcagggggatcacctgaggtcaggagtccaagaccatcctggccaacgtggtgaaaccccgtctctactaaaaatacaaaaattagctgggcatggtggcacacacctgtagtcccagctactcgggaggctgaggcaggagaatcgcttgaacccgggaggcggaggttgcagtgagccgagattgtgccattgcacttcagcctggcgactgagcaagagtccatctaaaaacaaacaaacaaacaaaaaaacacaaaactctccccttgagctttttttttagagagatttttgttgttgttttggtttggtttttttagataaagacaagttctcactatgctgcccaggctggtctcaaactcctgagctcaaatgatcttcccacctcggcctcccaaagttttaggattacaggcatgagccaccatgcttggcctctccttgagctcttttaatctggaaagaaaatctttcccatgatctccctgaaaggacttcccttcacatttcattggccagaactggtcatatctctgctccacgctgcaaaggaggctggaaaagggaagtgggatagtgtgactggcacagcccaatcttaatccctctcccctggctggacctatcacctcccacccccaaacaaaatcagggctctgctgttgaggactgagggtccagctattaggcagccagtaaagggtgtcaccatagtgtaaacctctgcttcttccagaaatctcactgacagggtaaaagggcacaaacacacagggcagagaacaggcagaggaagagatgatgccactgggttataaaagctggacagcagatgatgggtgagggaacccactgagttggccagagaaaactggcagcaagtgcctgcaggaaggttgggcgaggcagaggcaggtacatggcaccccagagccctgaaaggaccgagacctctgcagggagcactgaaacctgaggggtgagatgaaagtccccaaggaccctcatcccccttcacgctcatggaagagtccaaggtgaagcagttgaaccagggatgccctgaccacaggaatgggggttctacacagaaaacaaatgtaaatctgtctactgaacaatgagatctgcagactccttctcccacctcgccctcaggaacagctgcctaggacaggagataaagactttcctatcttgggaagcacccctgactgaagacaaaagagaaagctcccggaagataatgatttggagttccccaacaaaggaccacggccctacccaggcaccccaccatgtgacaggccctgcccagacacacggagcatgcaaaggtgattaattgcctcacactcaaatatcacagaacatgagacatttgagaactgctaacacgagacacaaacaggaaaaggtcctggggagatgccagtgctccttggctggggacctagtcttggatctgtcagaagctggctgtgtggcctcggcaaagtcctgtcccctctctgggcctcagtttccgtgtagttgaggagaatctttctggccgggaacttgcctcaacatatctcctactggggcatgtgagtcctttgctctgcttgagaaattatcctgaaaaccattgggttattttgtggatctcacctggatgacctaaagggtgtggatttcaagggcagaagaaaacttatcagtcctcacggtgcatgaaattccagcatgctcctctaaaggggacccttgaaacaaataaatttcaatggatgatactcaaaggatgtgtgggaagagcgtggctagagaaggctggctttgagcacttaaatgttgcctggcactttacacacattgtcttatttccttactctctttgtgaccttgaggaaccacttaactatgctgtgccttagtttccctatctgtgaaatggaatgtggttgagactgttagttgtccctaagtatcttcccctagttccatagtaatgaacttgtagctgagcataggactgtctcaataaaaagtacatttcccagcctcccttgcagtcagatgtacccatgtgaccaagttctggccaacgggatgtgactgtaagctatgtggctgatttccaggttgtactttattttattttattttattttattagttaattaatttatttatttttgagagggagtcttgctctgtcaccaggctggagtgcagtggcacaatctcggctcagtgcgacctccacctcctgggttcaagtgattctcctgcctcagcctcccaagtagctgggattataggcacacaccaccatacccagctaatttttatatttttagtagagacgggggggttcacctgactaggatggtctcgatctcctgacctcatgatccccccacctgagcctgccaaagtgctgagattacaggcatgagccactgcacccagcctgtactttatttttttaattattaattttaatttttttagagatgaggtcttgctatgttactcaggctggtctcgaactcctggccttaagtgaccctcccaccttggcctagagttacagaggtgaaccaccatgcccagccaggctgtatttttttttttttttttttagagacagggtctcactttgttgcccaggctggagtgttctggctatttacgggagtgattccactactggatcagcacgggagttttgacctttccgatctgggccatttcagccctccttaggcaacctggtggttcccctctcccagggagatcaccatgttgatactgagcttagtgtaggcacccgattgacacagcgcactacaacccagaactcttggactcaagtgattctcccgcctcagcctcccgagtagctgggacttctggctcacaccactgtgcccagcctaggttgtaccttaaagggaaagggtatgccattccccctttccttttcccactggctggaatgtggaatgtgacaccctaaggaggggaaaatagcaagttagcagcccgggcatgggcagtgggtgtctgcactgtcagccccagcctaacacactgggtgtgaagcctcaatgtgttgagacatgtaaatcacttaccacggggcttggaacaaagttggcattctgaaattgtgagctgttttattattaccatcaacgttatgattataatcatcactccaaatgggcctgtgcaagaaggcctcttaaggcccatttttcagatgagaaaatggagctcagagaggttaagcccctgcccaaatgatcccagggggagggtagcagaaccagatctgccaatctggggaaggagtaaagagaagcagtagagggtggaagggggagcagtcccaagtccccatgccagccccatgcaagtccccatgccagcccataccagccctgtctggttggtttaaggggttttcttcagcgggtctagtgcagtgggtcttaaccagggacacttttgtaccctgggcgacatttgacaatgcccggaggcatttttttttctttttgctttttctttttttttttttgagacagggtcccgttgtctcccaggctggagtgtagtgggcgatctcggcttactgcaacctccacctcctgggttcaagcgattctcgtgccttagcctcctgagtagctgggattacaggcgcccgccaccacgcccagctaatttttgtatttttagtagagacagggtttcaccatgttggctaggctagtctcaaactcctgacctcaagcgatccgcccacctcggcctcccaaagtgctgggattacaggcgtgagccaccgtgcccagccctgcattttcaatcaccgcgactgggagaggaagccaaccgccggccctagtgggtggcagccaggaatgctgctcggtaccctacagcgcacaacacggcccttgccagaaagaatcaacagggctgtgggcgaggagccctggtctcacgagaggttgcccacccctcacctggtgccccaggaggtgggaggcttcgcgggctccaggtcttgggcaggattctctgatttcttcccctggaaggcgtctctctgccctcaccgcatcttcctatcactcgccctctctgtccacacaggcccatttgtggggcaagggattttcatcaagaggaatctctaacctcagcccatccctgcaactcacccctgccgcctgccccgctcccgaggccgggaacaagccccaacagttcagccttcctccccacccacccgttgccagcaaggccagtttccgggtggtgggtggagggcatggtgccatctgaatacggtccagttctccccggtgggggagggagagaagggttttgctcctggaatgcagggcccacaccatcagagctgcccatctgtctgtctatccgtccatgtgagacaagagcggggactgttgagggaactacttccaaatttctcctccctcaattcccaggaggtggtgagccccagccttctaggatggcaggccaggcttccagaaccttccatctcagccacacaaaaccaagagactgaagcgaaaggtaaccccctgaggaactcccgggatttgtgaaaaattcaagagggagtggcgcctgggcctgatccgcatccagaggctgttctgttggtgagcagtggctcatttactgaagtacagactgcaccctgtggccgcggcagccacgcccctctgcacccaccagtcctgttcactggcctaggcttcaggccgccagcacctccatctttttgccaagggctttctctggccaccacaccccactgagcccatgcaggacaagcggagtacctgagagatcatgcccctggcagctgcccttaaccaaccactgacaggaggtgatggaggaagacgccggtttccttgccccttggtggaaatagcctggaggcatgtttacactggctcccagagttccccagtggaatcgagccccagttgcccagaccagtaacttgctcaaaaatgtcccctgtgtgtgtcttctcatctgtgtctcatgtccccactcccttactcccttacttcctaagactaccacccaaacaaatcacttgaatccttgcctcggtgtctgcttctgggggcacccagcctaagaccaacacagtctaagaggcagacacagatatttgcagatcaggatgaatgtggctgccccctctagcaactcacaatcagatggaaagcccaacaccactcagtcacacagacgcagaattgcaaatggggagaaggctgagactgtgaagcaacagagaaccttgttgttaaaaccctccaatgggctgagcatgacggctcacgcctgtaatcccagcactttgggaggccagggtgggcggatcacctgaggtcaggagtttgagaccagcctggccaacatggtgaaaccccatctctacttaaaatacaaaaattagccgggtgtggtggtgcacacctgtagtcccagctactcaggaggctgaggtaggagaatcgcttgaacctgggaggcagaggttgcagtgagctgagatcgtgccactatactccagcctgggtgacagagcaagactccatctcaaacaaacaaacaaataaataaaacccttcaggcagggcatggtgacttatgcctgtaatcccagcactttgggagacctgaggtcaggagttcgggacctgcctggccaacatggtgaaaccctgtctctactaaaaatacaaaaattagccaggcgtggtgacatgtgcctgtaatcccagctactcaggaggctgaggcaggagaatcacttgaacctgggaggcagaggtttcagtgagtcgagatcgtgccactgcactccagcctgggcaacagagtgagactctgtctcaaaaaataaataaataaataaataaataaataaataaaaataaatttttaaaaactctccataggccaccctcccctcccaggccaaaattcaggtcctctaggtcctgaaccatctgccaccccttccctttcctgtgctcacctctccccatcctgctccagccataatgggctgctggctgtttctcagttgtgctgtacgtgttcctgcttcaggacctttgcacttgctattccctctcctcagatgcttttccctagatctccccatggccggctcctccttctagttcaaatcttggttcacatgtcacctcctcatggggtcacctcagcacccatcccccaccacctcccaccagtcactttctaaccatgtcaccctggtatattgacttcatagcccatatcacagccggaagttatattgcttacttatgtgttgaatgatccccaaagatgggctctgtgaatatgagcagaggctgtgtccccggtgcctggaacaaaacctggaacagagtaggagccctatggctgtttgctggagaagtcattcaatgtttaagtgatgagagggaaaatgaatgaatgaatcatagaaagacatttaacagggggacccaaccttgtctggaaaatcagggaaggcttccctgaggaggtgacatggagctgagatatgaatggagatggggtattaactgagccaaagggacaggaagagctactcaggcagagggaagagcacatggaaatgtccagaggatcccagaggacacaccaggactgtgcaggggacaagccagctgtagccgaaggttttccttaatatttttgaacctattatgtgtccagctcacggatacatggagaacaaagcaggcaagttgctgtgcccctggagctcccaatctggtggggaggacagacactcaccaaagagtgggccaacatttagtcccaaagtttcagttgcccttgcacagcctcctcttacagtacactgttgatgcttgctttccagaatacgccactgagatgctgtgtagaaacacacttggcatgaacacacacacacatacacatacacaataagtgaagaattccctggatttcccaccaaaagagatcagaaaagacattcagagtagctcctttttgttgttaataatttaattaatcaccctctaccaatgtgatcaccattagcacagagctataatttcctgagttcaagaaagaagggagcagctatgccaattgtatgacaatgtgtcctcccatagaaaatttaaccgccaccaccccgccgccaccactagtctgacaacagccaaagccaggcccagtcacctagtgggttctatatgaagtgctgggatggagccaggttttatctctcggcctcccagttccgggctcgtgttttgtccctcccagcagtcagaaaaaggctccagctggacgctcaagcctcccctcccctcccctgcagggccacagtagaattggtcccactccatttgcatttcctaccgggctcctaaagccttttgagtttttgaccccaggatgtcatggcaggagggtcacagttagatacctgtcagggaattcttcatttgtgtgtgtgtgtgtgtgtgtgtgtgtgtgtgtgtgtgctgagacagcgtttctccatgttggccaggctggtctcgaactcctgacctcaggtgatccacccgcctcggcctcccaaagtgctggggttactagatgtgagccaccacaccccaccaaaagttataaatttatgcaaataaatatatacaatttttatttgtccagttaaaaaatatatgcaagtttttgtcaattaaaaaaatttcatgaggggagggggttgggcgatcagggaaagatgtctagacaggctcctagaggtgagagaaactccatgttagagggaaacatagggctatgggaactcctaacaagaccccttaacccagcctgggaaatcacagaatccttcctggaggaggaggccttttcactcattcttaaagggtaaagtcagctagagcagggtcaaaaaccttttctgtaaagggctagatagtaaatatttatgcttcatgagttcctgtcacaactatgattacagatctaaagcagccatagataaaactgaaatagatgtggctgtgttccaataaaactttattgacaaaaaccacacgctgagccagatttggcccccaggccatagtttactgacctctgagctaaacaatggaaaaggagaaagcaagcaaaggaagtcacttgagcaaaagctggaggtgtaaaagagcagagaattaggaaagagccacgttgtggttttccttctccctgaggcacagaaggagttgtctatgtttacacaaagacttgggctctgacgcaagctgagtgcaggattccaaattcaccccatcgacaagtatttattgagtgcctactaggtgccaggcactgttctaggcactgcaatgacacagcaatgaacaagagactttctcctgtggaagacaaacactaagcacacacaagtgaacaagcgagccaaaaaaaatacagcttcctcacctgctgtgtgaccttgaagatgttccttaacctctctgtgccccaggaggataatatgatcagagtgcaggcccagcacacagtggctgttctataaatatagctgctgttattattgtaagtcaatatgcaaataaatacacattaaaaaaaaaaaaaaaaggccaggcatggtggctcatgcctgtaatcccagctactcaggaggctgagatgggaggccgaggccagaggaccacttgagcctgggaggcagaggttgcagtgagcaagactgcaccactgcaacagagaaagaccctgtctcaaaaaacaaaaacaaaaccgtgacacaggtagtacccaggaaccgggcaggtgcatgagatgagggtggggggtcgactttggatcaggtagtccgggagggcctctgaggaagtggcagtcaaagacgccctggatcgcattctgtgagccaatatcctagaattagagtttgcagccccatgccctgcagactcgcaagagcagttaattaaaaatacctgcctctctggagcacaggaaggtgtcttctctaattagtgtgtgagtgtaaagtgctttgaaatccaaggataaaaggggagtgaggggtgaggctctggtcacagggccagggtgtcccactgggaagcgatccatgaacccgaagagctagactcagagagccatgctcgtgctcacgggcctgccggagccgaccctctctcaggttccaagtggagtttagggcagcgggagatgcgcccacctagggcaggctgagaggagcagagcacggatgttggagccagactccgaggtcatgtgcttaaagccgtggacccagcacgtggcagctagcggtgccaagttggtattagctgtttcccgtcttgttacatgatcgcttttgtgttcttgtttttgctgttgttgttacctgccatttactagccgggtgaccctgggtaagttactgaccctctctgaaccatgattttcttctctgagcctcagtgttctcttctttaaagtgggacacttgcagcccagcagtgccgggtgcaggcaacacgtgtggcacagagcagaacaaacaccactctgcccagtcagccattgccttgtgccaagcactgcctcaagcatattgtatgcgttcactcatttaatcctcacagacattattcccacttcctggacaaggacctcagagccaccaggaatagccatgcactgcccagctccagggggccccaatcacacagaccatgacatgaacagcagccctgaggctgtaaaacacagacaggttaagtttttcacccaaggccacacagctagtacttggcagaactgggattagatcccagactgcctggctccggagctgggctcctgaccctgggtcagcgctggtccttgtcaaggagactaaagtaacagagggtttctgagatgtagagaaattggttctccctttgcccaggcaagcaggcagcaagtctcaatctgccgatctctcgtttctctctagcctaagaacctgtatgtttctggggattttttgatgttttgttgttgttgcctcctaattttataagagcaagtcttgtatgttttggtttgtagggcatactgccatcctgggaggcttctgaatatgccacgacatcaggcctcagattggcgctgaggaagcgctaataatcacgtccccgtaatcccatgctcaaggccttcacttgacaggctcagagaggcaaagtgacccgcccaaggtcacacagctaggaagtggcagagctgaaataggacttctagactccagcttctttcttaattcccacatctgatgtctcaaactggtggcccatgggccaaatgcagcctgtagaatgtttgatttggcctgcgtgacgtttttgtaaaattagaatttatcatcagtatgtaaagaaacggatatttccaggaatagtattcaaaatatttaaccagactggcctgggcatcgaccattcagagtggctgctggtgggatagcagaagccaatggctactgcaaaaagacgccataaaaaatatcagatctggaaaatgcaaaaccatggagacaataaaaagataggtggcttccgggagtgagagggaggaagagatgtctaggtagggcatagaggactttctagggcagtgatatgatgacaatggtggattcctgtcattacacatttgtccaaacccataggatgtacaacaccaagagtgagccctaaagcaaattatggaccttgagtgacaatgatgcatccatgtagttcatcaattgtatcaaatgtaccaccctggtgggcaatgttgataatagtggaggctgtgcctgtgtcgggggagggggtaggtaaaacatctctgtacctttctctccattttgctgtgagcctaaagtttcttttaaaaataaaggcatttggccgggcgcagtggctcacgcctgtaatcccagcactttgggaggccgaggcgggcggatcacgaggtcaggagattgagatcatcctggctaacacagtgaaaccccatctccactaaaaatacaaaaaattagccgggcgtggtggcagccagctgtagtcccagctactcgggaggctgaggcaggagaatggtgtgaacccaggaggcggagcttgcagtgagctgagattgcaccactgcactccagcctgggctacagagcgagagactctgtctcaaaaaaataaataaataaataaataataaaggcatcctaagtcacaggatgagataagaggtcagcacaaagtacaggtcataaagaccttgctgataaaacagactgcagtaaaggagctggccaaacccaccaaaaccaaaatggccacgagagtgacctctggtcatcttcactgctacactcccattagcaccatgacagtttactaatgccatggcaatgtcaggaagttaccctatatggtctaaaatgggaaggcatgaataatctaccccttgtttagcatatgatcaagaaataaccataaaaatgagcaaccaggccgggcgcagtggctcatgcctgtaatcccagcactttgggaggccaaggcaggcagatcacctgaggtcgggtgttcaagaccagcctgaccaacatgaagaaaccctgtctctactataaatacaaaattagctgggcgtggtggcatatgcctgtaatcccagttactggggaggctgaggcagaagaatcgcttgaacccgggaggtggaggttgtggtgagccaagatctcgccactgtactccagccttgggcaataagagcaaaactctatcaccaaaaaaaaaaaaaaggcaatcagcagccctcggggctgctctgtctatggagtagccattcttttattcctttattttcttaataaacttgctcttacttcacacacaaaaaaataataaataaaacttacttttggccgggtgtagtgctcacacctgtaaccccggcactttgggaggccacgacaggtggatcacttgaggtcgggagttcaaaaccagcctggccaacatggtctctactaaaaatacaaaaattagccgtgcttggtggtgcgcacctgtaatgacagctactagcaggggctgaggcaagagaattgcttgaacctgggaggtggaggttgcagtgagctgagatggcgccactgcactccatcctgggcaacagagcgagactccatctaaaaaaaaataaaataaagtatatgttttaaaaattcagaaggtttggctacatggctcccacatttttacaggaccatgatggctgcagtgagttccaggtgcctccatagataaagcgtgtgtgcccgagcctgtcggtcccctgagactgcctccctctgtagcatcagccagccagtccccgcaggcacctgagcaatgactcaggcatgaaggggattctttggaagttcctggtgagaaagagaaccgggtgaaagtgtggcctgcaggagtggccaatgaggagcaaagaggagggtgacacccgcctgtgtcagctcctgctcatcatctccccagtgggagcctcctgtgcactttccacaggaccgagtgagccactcttgattcacccttcctctgcccaggcctgcagtgggcgggtgcccaccgtggtacacagcccatgaagcagccaccctctgccactgaggcttggcagtctgaatggatgccagcctatgagattagaaggaaaatgggcaggatgtgaaaaatcagaagctgcctgactactcctgggaaattgttcctgagaccatgcccttcctgcgtctacttgtagcatcgctctttcactgacaagcatgtatcgagtactaggcaagtccaaaggaggtcttgaagtagatacagcaggacaggcaagaggctggttccatggccagctgctgtttgtacctgaccaatgttcctcccccatgttccggtaacagcacccttccaccactatcactccatgtgcctccccaaccagaggaggtggatgaatgaggcctgggaagtcagcatattccatccccccggccccagggattggtctgagatgggtatgtgacccaagtctggccaatcacagtcaacccctagacatgtgctgaggctacacagaaagtcagcttctgctcacttggcttgtcgatctggcagaatggaagctgggggatactggggactatttttgccaccacataaggtgaccctaactgacacggaggaaaacagaaccaagaagtggaaacagcatgattcctaaacaacagatgcacacctggatccagccattcctgaagctgaaggtcttttcatttaaatgaaccaaaacattcacagaaacacacactattttttttcttaagtcactttgagttgggtttgtttctgtcactttcaaccaaaagaccctgactatacaagtggatgtatagctgtttccaggctggaaaacaaacagctatggcaaaagcagaccatgagacatccatgtaaaatctgggagttgagggctgggtgcagtggctcacacctgtaatcccagcactttgggagtctgaggcaggtggatcggttgaggtcaggagttcaaggccagcctgggcaacatggcaaaaccctgtctctactaaaaacacagaaatttgctgggcgtggtggcatgcacctgtaatcccagctactggggaggctgaggcacaagaatggagaattgcctccctctgaactttttatttggtgctataaataaaccctttcaggtctgagcggcagtcaggtggatttccagttacttgcagctgaatgcatttctacctgtcactcctcctcaggaccataggttgctctggattcccaccacacacgtggagatactgaggtctggaatgcagagaaaacttccccagtgtcacgtggtggagtcatgagtttactgactcactacccagtgctctttccgctcaagacaacctcgtggtccgttcctttcattcgggctgctgtatgcatggccaacagctgctttgtaaattaaacacttcccatggaggcagtgatgatgatgaccttgcccctgaatctttccagcctcttacgtaaatcgcccctgggtcactgtctccatgcctttggacccaggacagcttccccacatcctttaaaacgatgagataaccacatgtaaacccagtgctcctggaaaggtgtgagtcatgcatcacggaacagaaggttcacagccaggagtccgcctatcatgcttgtcatccagccttccaggcttgcgtggagcttgttcactgcaaagctgattcatctgcagcttgtggtcagctctgacactcagatcattttctgctcatcttgtgcctggctagtgacctttaattaggtgctgtcaacttcctgtcttcctgtctctgtccatgttgtctttccccctattttaaaaggactgtatgaatactaaagacatgatgatgatgatagcagttagcacttactatattctaaatgctctatataaatttaaaagttgtttctcaaaagccattgtctgagataactagtattactattgcagttttatggattggaaaacaagggcttagaaaagtgaagtcactttccttgggtaacagagccaggagtatttggtggagctggaatatgaacatgagtgtgttggaccctggagtgcagctcgaaaacacaaagccagttgagtctgttaagctagcttcagaggctccactacagcagtttagactctaattacatttactgtttgtttaaaagacttctggacagactggagacctcatggtgtatttgtcatcttaaggttgtcataaaggacccacagtctttgcactttccctctcctccgtcaacagcaagtcagcaacttgtcctcagtctggtcttcacatcacagatggctgccacagctcacgcatcacctcttcacacaacaatgtccaaagcaggcagagaaggaaaggggcaaataggtttctctttatgtgcctctttcttgtcatagagtaaactctttcccagaagcccccagattagtttccctttggacaaaactgggtcacgtgaccacctctgagccaatcgcaggtccaggagaacagggtggctatgactgggtaaagcaaatgcagtttttcccctaggactaggcacatggccagctgcagaaagtcagggttttctcagcaggaaaggagaggggaatggcagttgacaaggcaacccgcagtgtctgataccccagcatttaaaaatgtttagcacagacacccacgttgatttgcaatatgattgtaggtggtacatgaagttgtggttgcgtgtttttaaataattttagtatttattaagtatttaaatgcatttgaaaaaaacatataggccaggtgtggtggctcacacctgtaattctagcactttgggagaccaagactggcggatcacttgaggtcaggagttcgagaccagcccggccaacatgatgaaaacccatctctactaaaaatacaaaaattagccaggcgtggtggtggtgtctgtagttccagctactcaggaggttgaggcaggagaatcacttgaacctgtgaggtgggggtggaatgagtccagatcgtgctactgcactccagcctgggtgacaaagcgagactctgtctcaggaaaaaaaaagaaccaaaaccatatatatggctatctcatcaatcagaaccacaacaactataaaacaactatatttaaggttttttgcaaaaaaaaaagttaaagaaaatattaagtaaataatagatcatttgcttcaagatttggcaaatgtaaggataggaaacgctgttctatgttatcctgcttggccttttttccaacttctcagaggcgttctgccttcaaactccctcttgaggaaaataaacacccacaaagatttttgcatcatctgcaaatatgattcaaataaagccttgagctcaaatataatccaggcttcctcagctgggaaggacaggcatctcgagtccaagcctttcctggtatttcacctctgtcttcatggttttatggggttttattgggtctgtccctcctctggaaagccaccacaaatccgatttctgagagaacaagatataaataataaacagaatgactccttgagatttcttgtccttgtgaggaattttcaaacgttcctaagacatgaaatcttttcgtttaaacaagagtttgggagtccgtcatgagaactggataaataatggcccagtgacacagggacatatgtcagagcctttgttcaaagaaataaagtagctcaatatgtgccgatagcaaaaggcgcctgggatctatcgtgatgcgagaacagcaaggtacagaacaatatgtgcgaggtacagaaccatatctgcagactttttctgtaaagggctgcatagaaaatcctttgggcattgcaagccgtactgtctctgttgcagctgctcagctctgccatcgtggcatgaaagcaatcatagatagcgcacaaagcagctgggctgtgtatcaataaaactttatctatggacacagatgtacattgcatataatttttgtgtgtcataaagcattcttctttcttttttttttttttttgagacagagtctcactgtgtatcacaggctggagtgcagtggcgtgatcttggctcactgcaacctccgcctcctgggttcaagtaattctcgtgcttcagcctcccgagtagctgggactataggcatgcagccaccacacccagctaatttttgcatttttagtagagacagggtttcgccatgttggccgggctggtctcaaactcctgacctcaagtgatttgcctgcctcggcctcctaaagcgctgggattacaggtgtgagccactacacctggcctcaattttgttttgttttgagacggggtctcactctgtcacccaggccagagtgcagctgtaccatcacagctcactgcagcctcaacctccctgggctcaggtgatcctcctgcctcagcctcctgtgtagctgggactataggcatgtgccaccacccccagccaatttttgtattttttgtagagatggagtctccttatgttgcccaggctgggctcaaactgctaggctcaagtgatctgcccgcctcagccttccaaagtgttgagactataggcatgagacaccgtgcctggcctttctttcaaattttaaaaatcatttaaaaatgtaaaaaccagccgggcatggtggctcatgcctgtaatcccagcactttgggaggctgaggtgggtggatctcctgagttcaggagtttgagaccagcctgaccaacatggtgaaaccccgtctctactaaatacaaaaaattagctgggtgttggggtgcatgcctgtaatcccagctacttgtgaggctgaggcaggagaatcacttgaacccaggaaggggaggttgcagtgagcccagattgcgccattgtactccagccttggtaacaggagtgaaattctgtgtcaaaaaaaaaaagtaaaaaccattcgtagcttgcaggccatacagaatagtgagacagatttggcttgaggacgataatttgccaatccatctataaacctctgatgcataacaaaattgtagagaaacaccagaagtatagagaggcatgctacacgtgcgtgtgtgcacgtgcgtgtgtgtgtgtgtgtgtgtgtctgtgtgtgtacagctggctctccatacccatgggttccacccatccgtagattcaaccagtcatggatcaaaaacattcaaagacgctgggcgtggtggctgtaatcccagcactttgggaggccgatgctggtggatcatgaggtcaggggttcaagaccagcctgggcaacatggtgaaaccccgtctctactaaaaatacacggtggcatgtgcctgtaatttcagctacttgggaggctgaggcaggagaattgcttgaaccgggacccgggaggcagaggttgcagtgagccgagctccagcctgggctacagagcgagactctgtctaaaaaaaaaaaaaaaaaaatcaaagaggccgggcacagtggctcatgcccgtaatcccagcactttgggagaccaaagtggtggatcacctgaggttaggagttcgagaccagcttggccaacatggtgaaaccccatctctaccaaaaatataaaaaattagtcagtgtggtggcacacgcctgtaatcccagctattcaggaggctcaggcaggagaatcacttgaacctgggaggcagaggttgcagtgagccgagagcttgccactgcactccagcctgggtgaccgagtaagactgtctcaaaaaaaaaaaaaaaaatatatatatatatatattcaaagaagaaatgtgtctgtactaagcatgtacagactttttcttgtcattattcactaaacaatacattaaaaccactatttacattggatttacattgcattacatattataaataatctagagatgatttgaagtgtacagggggatgtgcctaagttatatacaaatgttactttattttacataagggactcaagcatctaaagattgtgatatctgtggaaggtcctagaatcaatccccaaggataccagggacaactggagagagaagcggggagagagagacagatatttgtttatatctctaaaaggacacactaacaactggcaacaagaggtgcttctgaagaggggaactgggaaatgtcagaggaaatgagaaggaagatattttgcacgacatggccttttacactgcttgagtttttctccacatgcttgtgttacttttacaaagcagaaaacatttgccaaaggattactatgccacagacaataaaaatgagacgctataaacaaatatacacagtcatgcatcacataatgacattggtcaatgatggaccacatatacgaccgtggtcctgtaagactgtaaggcggtatttgtactgtatgctctctacgtttaggtatgtttagagacagatacttcccattgtgttaccattgcctacagcaggggtccccaaccctccaaggtaccagtccgtggcctattaggaactgggctgcacggcaggaggtgagtgacaggtgagtgagcaaagcttcatctgtattgacagccacttcccatcactcgcattaccacctgagctccacctcctgtcagactggtggtgccattagattctcataggagctcgaaccctattgtgaactgcccatgtgagggatcttgattgtgtgcttcttatgagaatctaacgcctgatgatctgtcgctgtctcccatcaccctcagatgggatcgtctagttgcaggaaaacaagcttagggctctcactgattctacgtgaaggtgagttgtataattatttcgttatatattacactgtaataattgtagaaataaagcacacaataaatgtaatgcacctgaatcgtcccggaaccatccccctcacactggtttttggaaaaaaatttcttccacgaaaccggtccctggtgccaaaaaggttggggaccgctggcctacagttttcagtacagtcacgtgctgtacaggtttgcagcccgggagccacaggctccaccgtgtagcctgggtgtgtagtaggctatgccatctaggcttgtgtgagtacactccgatgttctcgtcatgacgaaatcacctaacaacacacttctcaaaacatagccctgtcattaagggacgcgtgacttcacaggcaatcacagcacaacttcagcgggtgccgttcattgggccatttgtagaatggagccattggagttgtgagggcacaccccatgtggcagccctgttggtaacaaaactaacaccaagagtttctatgaagtgaaatttgtgagtaaatattaaagaagtagggtcggagtggaagttgtgggaggggaataaaatctcactctttccgttttatgctattccttatcaggaccacaataaagccaatcttctgccaatatttacttttgatttttttctccagagtggaagaaaaatgcccaggcctggcaggaataggagagtaggattgaaagttgaaacaagagcaggaagctcacccggaaataaaatcatttccagaacctcacaatgaaaatgacacttatttcacagaaacactcaaaggctgactccacttacgagactcctctcttgtaaccccagtcagctttcccagatatcttgggattccatgaaacccactgcaagcattttgacccaggttggaggcctcaaacagcagtctcccacctaagaacatggaagatgtggatttttggtcagcagtggtttcaaaatcaagacatttcatgtaaatgcaggagtttctggcttcccttgaaactcttggctctctggccgccctgagcccacattcccacgtggaaacttcaggctgccgtcaaacggtagttgctccttccagatggggcaagggctccccgtttgccacagtccccaccactccctgtcgccctccatcaggaccacttcactcaattctttttttcatttgtacttcattcactcaaccaagatttattgagcacttactatgtgccagaaagctgcaaacaaaactgacacaaattcctccttcatgcaacttatattctggctggtgaggcaatgaagaaaaagaaggaaaagcataaattccagagggtggtaagttctgctgacagtgaaaatagtgctgcaaaggtggagaaggcatgctgggtgtggtcaaggaaggccttaggaggaaggtacatttgagcaaagatctgaagctggtaaggacagcaagccttcaggatatctgtggaaagaacagtccagccagcaagaacagcaagtgcaaaggtcctggggcaggactgctccttgtgtgtctgtgaagcagcaagaaggccagtgcagctggagaagagtgagtgaggggaagggggtggaaatgaggtcagagaggggatgaggtatcaatcttgcagggcctcataggatctttggcttttactctaagtgaggtgggagccgtggaggattctgagcagaggcaatgtggttgtatgggtgatagactccctctagctacatgtggagactggactgtgtgtgcgaagcgggtggggtgggatggaggagaaaggtggaagctaagaggccagcaaggacccactgcagtggtccgggtgcagggtggcagtggcaggacagggcggtggctatggaggtggtgacaagaggttggagtctggacatactgtgtttcccggctctttttttttttttttttttttgagacagagtttcgatcttgttgcccaggctggagtgcaatggcacgatctcggctcaccaaaacctccctctcccaggttcaagtgattctcctgcctcagcctcctgagtagctgggattacaggcatgcgccaccatgcctggctaatttttgtagttttagtagagatggagtttctccatgttggtcaggctggtctcgaacccctgacctcaagtgatcctcccgccttgacctcccaaagtgctgggattacaggcatgagccaccgtgcctggccttcttcttcttttttttcttttttgagacggagtcttactgtgatgcccaggctggagtgcaatggtgcaatcttggctcactgcaaactccccttcccaagttcaagcgatttttctgcctcagcctcccaagaagctgggactacaggtgtgcaccaccatacctggctaatttttgtatttttaatagaggcggggtttcaccatattggccaggctgatctcaaactcctgacctcaggtgatcctctggccttggcctcccaaagtgctgggattacaggcctgagccaacatgcctggcctgtttcccaactccttttggcacttaggagaaactcccctcactcactctcctccagccacattgtgcttgcatgatccaacctcagggcctttgcacttgctgttccctctgccctgcacacgccgcccccagatattcccaaggcttcctccctcccttctcagggctaaagctgctgaaacagcccacattcctgacattctcctcccttgctctgctgggttggtcactacagtgaacttcctggcctcaatatacaggagacgttttttcttgttgttgagttgtctatctcctgccgtagggcatcagcttgaggagggaaccagtgatgtctcttttttttttttaaacagagtctcactctgttgcccaggctggagtgaagtggcacaatcttggctcactgcaacctccacctcctgggttcaagtgctttagcctcctgagtaactgggattacaggtgtaagccaccacacctggcaattttttttttttttagtagacatggggtttcaccatgttggcccggctggtctcgaactcctggcctcaagcgatctgcccacctaaccctcccaaagtgctgagattacaggcatgagccaccgcgcctggccagcaatgatttctctcgttcactgctgtatccccgagtctaactatgcctggagcagagtagtccatcagtgggacttgtagaaagaatgagagaaggcgtcagagattgattttgtttctgccactcattagtgtatgacctgtgcaaatggctcctccctccatccccagtatcctcttctataaaatgggtctctctacataacctctgtagggctgttgtgagaatctgggaagcctacggcaaaaagcctttagcaccattcagggatcttcgaagctgtccgtgttaggtgttgctatgaaccttaggagggaatgagaggatagctggaagagagtcacccccgcagaggccaagaaggaagagagaaacacgtttgtcctaagatgggacaaggctgttttttccagtattttcagtaagaaaacgaaagagcatccaagaatctcagggcacagtccaggctgcaagcttcttggctgtctggcctctgcccatctttcctgctctctgctccagcctatagctcccttccccgcagccctgtgagcccctcagtggccccaggatcctctgctcctctgctcctctgggaatccagtcccctccggctgaatgcctcaccttcccctggggtctaccactcagccctctgcagccagcccagctcctgtgtggaattccctggtggctggtatgagggggtgcccagcatcccctcctcatcctgtgacagtggataagggccagctgttagcatcattgttgttattactattacacaaacgcttccaatggatccacaccacctaagcagcgccaggaagccagggaaatgccagaagcaataacagtcagcaactatgtagtacctactgtgtactgtgctgtattgcacataggcaccgttccaagcccttcgtgctattaactcatttgattgtcacagtgtatgaggcaggtactatgttaactccattttacagataatgaaacagatctagagtggttaagtaactaaccactgagaaagctagattcaaatttgtgggttggctctaaaacctgttgttttaattaactctacacactgctgccttatggcattttattgtttgaaataataacatttcctgagcactcactatgtgccagctactaggctcagaattacctttcttcaccctgaaagaccctatgagttcatttgattattaaatagtcccattttacagaagaagaaactgaggcatagaaagatagtgcctcacacagtgtggcaaattgtgttttctgtttttttttttttttttttcttgctctgttgcccaggctggagtccagtggcaagatcatagctcactgcagcctcctgggctcaagccatcttcctgcctcggcctcccaaaatgctggaattacagggagtgcacccagctgcgcatcgtgttgtcttaagatgcttacagcatcatctctcatcctcatgatctgtttctgcttctttttttttgtaaaaaaaaacccccccagctttattgagatataattcacataccataaaactcacccttttaaagtacacaatccagtgggttttggtgtattcacagagttgtgcaatcatcaccactacctaattttagaacacttgcattgcccccgaaaggaacctcacacccattagcagtcactcccccttcccaccatgttgtgaggaaacccaaaccagcccaagtgaagagaccacacgaagaagtcacacacaggtgtctttctgatggcccagctgcggtagcagctgccagacacgcaagtgaagactctccgaccgaggccagcaccccagccaccaagtcgccctcagccttcaggctgtcccagccgaggccccagacactgtggagcagagacaagctgtcctgctgtgccctgtctgcattcctgaccacaggatctgagagatatcattccaggcgagtagaatggctgctttacaccgctgtgttctggggtgggtttgttatgcaggaggagtaaccgagccacagctggtaaggggcaatgctcgggtttgaacccgagtccttctggctttgaggctgccccttaaaccacatataggctggatgatcccctggatgtggaggagtcggcactccctttcttgtgcaatcgactcagtgcatcggggtgacgtgccctttctctagctgaccttctggaagcacataaacggagacagaaatgctttctttttgttttgccagtttattgctgctgctgctgctgcagttcttatttagtatatatgaattcttgttcttattttttgctagttagagtaaggctgggcgtggtgaccctcagctgtaatcccagcaccttgggaggccaaggtgggcagatcatttgaatcccagagtttgaaaccagcctgagcatcgtggtgaaaccccatctctacaaaacaaatacaaaaattagccgggcacggtggcatgtgcctgtagtcctagctacttgggaggctgaggtgagaggatggcttgagtctgggaggcggaggttgcagtgagccaagattgcggcattacactccagtctggccgacagagtgagagcctatctctcaaagaaagaaagagaaagaaagaaagaaagaaagaaaaagaaagaaggaaggaaggaaggaaggaaggaaggaaggaaggaaggaaaggaaggaaggaaggaaggaaggaaggaaggaaggaaggaaggaagaaaggttagaataaatagataagaaacacaaaaaatccacctgccatccccactacgcaggaaaaacctccacataacacttgaatcttgtagaattgtatctaccaggcatttaactcacgcaatttcactgggcatcagtgggccaaaaagggtgatggggagagtgacaatctttattttttcgtttcttttctttttctttttttttttttttgagagagtcttgctctgttggccaggctgcagtgcagtggtgcaatcttggtttactgaaacctctgcctcccgagtttgagtgattctcctgcctcagcctccagagtagctgggattacaagtgagcaccatcacgcctggctaatttttgtatttttagtagagatggggtttcaccatgttggccaggcagatctcaaactcctggcctcaagttacctgcccgcctcagcctcccaaagtgctgggatttacaggcgtgagccaccaagcccggctgagaatgacaattttcatatggcaagtgagtgtagctggcaggtcctattttttgttcaacatggccccaaacacaagatgacccctctccatccaggggctatttggatttgctaagtgtttataatgcaccacggttgagaggaaatttaacatatttttcaggatcatttttgattctgcataaaaagagaccttttttatcccttccaaaaatgggattgagctatgcagatggttttgtacctgactttttcacgtaacaacgtactttgaactgcttttgggcaagtggctttctcctggccttcatgggaaggaagcgctctgggagtccacctgcgctcttgctgagtggcagtcaaagtcgactggaactctacaagctgtgcagtcaggatgctgagcaaaagaagccagatgggaagagcacacactgtgtgcttccctttatagaaagttcaaaaccagcaaaagtcatctatggggttagaattcaggacagccattaaccttgggggtggtggtggggaggatttaccaggagagacatcaagggggcttctggaatgtcctgtgtacatctgggtgctcattccacgaatgtgtccacttggcgagaattcactgagctctttatgtataatgtgtgtacttttccttgcaattaaaacacacatacaaacacacgcagatgcatgcgtgcgcgcgcgcgcgcgcacacacacacacacacacacacacacacacacacacacacacacagtgttcttagagcgcaggctgtcctgtctggaaatacatgtttaatgcttttgccacatatgggcagaggtgagtgttgagaggactgggtatgaagttgggaacccaagtctgaatcctggttcagccatcattaaatgtgtgaccttgggcaagttacttaacctctctgagcctcagtttcctcatctggactctgtaccaagcccacaagatcacagaagcagccactgctcgcctctccatctggctcttccgttcttctctggctgtctctctaagcccacaccacactggccaccattcttgttcctatcacagcaaagctcaatgtggcctcagggcttttgccctagctattcctgctgcctggaattaccctttccctgattttcttgtggttggttccttttcctccttcatgtctcagttcaaaggttaccttctcagagaggagagcccctcactgaccactatccacaccagccatcatcagttccattccctggcctcagtttcttcccagtgcctcttaggttctgaaatggtcatatttgtttcttgcattgttgttgctctttacttgttatctgcttggcactccctctagacccatggactctaggacatgaggaatcatgattgtcttgttcattgctacacctccatcacataaaacaatgtgtatttgttcaattaaccaatcaatctatacagcgatctgattctactttatggaattctcgggaagtttcgaaagtacgttttaaacagccaggtttataagaatgaggaaactttgaaagctctgtttgaatgtggttaactctactgagaagaatctagataggcccaagatgcttcgtgagctgcgtcttccataatttcatctacactgaaagtcactataccgcttgcaaccacccgccccccacctccaccttttgctatttgcaccttttgttattggccatttggctggaacaaagtcactaatattcttagtagtttatttctatatatagagattttctttttttttttttttgagacggagtcttactctgttacctaggctggagtgcagtggcatgatctcggctcactgcaatctctgtctcccaggttcaagagattctcctacctcagcttccttagtagctgggattataggcatacaccaccgagccctgctaatgtttgtatttttagtagagatggggtttcaccatgttggttaggctggtctcaaactcctgacctcaggtaatctgcccaccttggcctcccaaagtgttgggattacaggtgtgagcccccacgcctggccaacatggttttaagatggtcaaaaggtacagagtgtacaaagagaagtctgtctccctctgactactgctctagagccgattagtgtttccaggtacctagtaagcgcttccagaactgttctgtgcagaaacaggcatgtgggctatatcttcatctttcccgtttacacagaaaggatctagttcaatacactgctttatatctttgctttttcttttttcttctttataattgatcttggagctgtttccataccacacattgtatgtgtatgttttagttgcacagaaaggtgtacgcatcaagagctcagagagtaactggtctctctctctccttctctctctctctcttcttttaagacgaagatttgctcttgtcacccagggtggagtgcagtggcctgatctcggctcattgcaacctctgcctcccaggttcaagtgattctcctacctcagcctcttgagtagctggcattacaggcgtgcaccaccacgcccagctaatttttgtacttttagtagaggcagggtttcaccatgttggccaggctggtctcaaactcctgacctcaggtgatctgtccacctctgcctcccaaaatgctgggattacaggtgtgagccaccgtgtctggccatttttttttttttttttgagacagggttttgctctgttacccaggctggagtgcagtggcatgatcttagatcactgcagcctctaagtcccgggttcaagaaatcctcccacttcagcctccctactagctgcgactacagtcattctttttaaaaaccatagaatactgacggacacctcaggcagctctggtcttttgcttctgcaggcagtgctgcagtgatggtccttggatgcacctttgggcccaggaaaatcactgattccttttgaatctggtaaagcaacccgagagtttacccctccccaacctcatcttcacccctcggcccatcccgcccttgctggtgtttgtgttttggccttttaaagactttttcaaaattgactttggcttcttggcctgaactctgaagtgtttgagctgataagatagcaggcttggctgtgggggccaggggtaaacagtgaccccggggccctcagccccagtaagggaggggccacagccccaagtctctcctgtctccagctgtgggagcaggcggtgtggctggaggaggaagctgaattgcgttgggctccagatgggtttgggaaccggaaggaagtgggaagctggccccacacagacccacttctctgggcctttgagaacagtgccaagaggcgcaacatgggctcagtatttgccggggcctctcctaaaccaaacaggacgccacgggcaagttggagcaaagtcctggcaaacctgaagacacatcccgtggagccccaaggagccgagggtcacaggaggggccctgcctccaaggccgtggcagacagaactggcaccatctccacacagcgtcaccgagtgatgtccagtcgtctcaggccggggattgtaactgccccgctctgatctaggccacagaagtgaacaaatcagtttggattcccaccctctagaactttcttcagttgaggagggaagagagaggataaataggcaaaaactggccagggtgcaggggactacaatggagaatggccaggctgtgggggcagagcaggggcactgctcaccctggagggggaaggcctccccagtcatgcctcgtcccagcttaaaatgctttggggcctgccatggtttctcagggctcctgggaccatggcctctgcgtgatcttccctgcccacctctaccagcagggtcagtggtgccagcttggcaacacttggtgcccatgtctacctggggtccctgcatggctgctccctctgctggcagcgccctcacctcccacctcccactcagctctcagctctcagctgagatgtcaccttctcgtccaggaagccttccttgatgtccctggatggtcttggggctatcacatgctcctgtacattcctcatccctgcttcagtcactctggggttacttgtttgcgggtggcccaaggtagcccagcatggccagaacccagccctgtggatgaccctgctggattcaaatgctagctccgcctcttagctgtgcaaccttgggcctcagttttgccatctggaaaaagggcatagtgatggcatctacctcacagggtggttgtgaggaagaagcagtttaatacaagtacttagaaagacatctggcaccaactttgcactcagtaaatgttggctgtgccattacacttgttctctctcccacagaacacagcaggtgctcacttcacatttgcatgctaaatcagtgcagcccttcaaatatgctcatgaaaatgagcaatgggggggaaggcttagttaattcagatgctcctcgacttgggatggggctgcagcctgataaacccactgcaagttgaaaatatcattaagtcaaaagtgcatttagtgcacccaacctacggaacatcatcatagcttcgcctcgcctcccttaaaggtgctcgaaacgtttacactcacctacgttgggcaaaatcatctaacacaaagcctattttataataaagtgttgagtatttcatgtaaaattattgtactctgtattgctaaactgataaaagattaaagttcaaaattccaagtatgatttctatcaaatgcctatctctttcgtaccataataaacacgaaaagtcctaaaatgaaccattgttagtcgaggatcatctgcaacggaaaaatttttttaaaacacaacagtaaagagtgatttacaactatgtaacacacacacacacacacacacacacacacacacacacacacacacagtccaataccctggcttggggaaaagaaagaaacagaccgtttagtgtggttttgttagaaggatgggacaaaaaaataatttttcttctttcttgtttgatgtgtttttttctactcttctttaataagcatggtttcaatttaaatgggaaaaaaaataacaaagaatctagagaaggaacccgcaagccctttctgttccatagagttttcccacaaactggggcagggggtggggtaggtggggtgtggcggggtggacagagaaagagctgccctttagaagttaagcaagagcaggaaaaccatcgtgtgccgggcgggggtagggtgtcagcttgaccaggggaagttgtggcaactaataacaaagcaactcctctcccaactctgggcatggcaagacatgcccccactccccagaccccaagatggagctagcaaccctgcctaatgccacggccctgtgtttccctgcagcgtaacacgtgtcgcacggcagcgtctgtaaagaaagggccttgtccgggcgcggtggctcacgcctgtaatcccagcactttgggaggccgagacagacggatcatgaggtcaggagaatgagaccatcctggctaacacggtgaaaccccgtctctactaaaaatacaaaaaaattagccgggcatgatggcgggcgcctgtagtcccagctactcaggaggctgagggagaatggcgtgaacccaggaggcggagcttgcagtgagccgagatcgtggcactgcactccagcctgggcgacagagcgagactctgcctcaaaaaaaaaaaaaaaagggcctcaccacctgccccctactcgcgtatgttacctcgcctcacctgcctaaccctgaagacctgcctgcaagcagtaaggtactactgttagccccatttcacagacggggaaactgaggctcaaaaggtgtaataatttgcccaaggttgcccagttgatcaatgacagagtctgaacttaataccatttgggctggatgtggtggctcaggcctataatcccaaagttttgggaggccaagtcgtgaggattgcttgagtccaggagttcaagaccaacttgggcaacatagtgatagctcatctctacaaaaattaaaaaattagctgggcatggtggcatgcacctatactcccagctactcaagaggctaaagcaggaggatctcttgagccctggaggttgaagctgctgtgagtcatgatggtgccactgcactccagtctgggtgacagtgagatacacacacacacacacacacacgcagattttaacaccatttggttttatccttgtctgtgatgtctgtgatttgtcatctttttttccatttccactaaagtagatgttaacaaatggaaggctggaagaatggatggatgaatgggtgggtggatgataaatgggtggatggatggatggaaggaaggatggatggatggatggatggatggatgaatgggtgagtggatgataaatgggtggatggatggatggaaggatggatggatggatggatgggtgagagatggataatgagtggagggatggatgaatggatggatgggtgggtggatggaaggatggatggatgggtgagagatggatgatggatggagggatggatgaatggatggatgggtggatgaatggatgggtcggtggatggatggaaggatgaacagatggatggaaggatggatggatggatggaaggaaggatggatggatggatggatgagagatagatgatggctggagagatggatgaacagatagatgggtggatggatgaatggatggatggttgggtgggtgaaggatggatgatggatggagggatgaatgaacagatgggcaaattaatgaattagtggatgactgggtgggtggaatgcatgcataaaataaatgggtgactgaatacaaaaagaactaactaaataaataatgatgaaaggcagagggcactaagagggtttcacctttcagggtttgttcctggacattgaatgtgccctttggaaagattgcaaactggcagttatcagggtaaattgggctgcagacatattttgtttgatcttcacagggtttttaattttttgaattgtcattattttaaaattaggaaatttcacattaaaaatctagatttctgatttctcctgcaaaattgggccggcacccataccaggaaataatataccaggactgacggggctgagcctctgagtgctcacggtccccactgctccacaatgcagtcctgctattggggttgtgtccactgccatttatcatggcagtttgggctggtgtttttctcagtaccattacaaggaaaatgaaaaatctcttacaggtggctcttggtcaaaagtggaaaatgaacttaggtaaagaggaaattgggagagaagtatttctttgtggccatggagaacactcctgtggattcgatggaccagcaatgcatcttgcctgagtggttaggggcacagatgctagagcctgatggcctgggttcaacccccggctgtgctacataccggctgtgtggcctcgtgcaagtcactgaacgtttctggcctcagtttcctcatgtgtaaagcagaggtggtgtcagtccccacctcatagagtgtcaatgattttctctccgtggggctctctaggtgtgagctgctattatcttacacagggctggctcccgtcatgtgtgtgatctgcctaccctgagcgtccacagcagcggttctcaaccaaggtcaactgtgccccccaggggacatttggcaatgtctagagacatctggggttgtcacaacttgggtggggaggggctaccaacatcttatgggtagaggccagggagactgtgaacagcctgcaaggctcaggacagatcagcaaaagattctgctgccccgtgtactccgccccgtgtactacgtgctgaggctgaggaacccggatctacaggagtccaagtccccagaggggctgagctatggccagatatctaggagtccctgaaggctgccagaggtgattccctctagacgtggcaggagccattccctctggcctgagccacctcagccctcaggatcatcaggccccaagtagtgccccgtcccagggtgcctggccccagcctgctcccagccccatacaacaggcaagaaatgtgtctgtccctagcgcctcctggtggcccagccctaaactacatgactcttcccagcccagggtggtgggaggggaggatgaggacgtaccttccgggtgtttaatccagactagttgggaatgtgggaatttaaggtcatggaaggcggtagccaatgtttcaaagacaaattgacataggtttgaatctcagatcttccactgaccatctgggaggccttggacacatcccatgactctcctgggcctcagtttcctcatctggaatggggatgatgttatttatgtcacagtttcgttgggaggattaaattaagtgcataaacagatgaaacatacgagatgcttaggattaaattaagtgcataaacagatgaaacatacgagatgcttaggattaaattaagtgcataaacagatgaaacatacgagatgcttcacaagcctcctctcggatacttgttattgctgtgttcatagcaattcatagccacttgtgtttgatgaatttccagtgtactcagagtgatttttttcactgactatcaacaaataattttgctgcaaagaaatacagatatgggaaaggatgcacaatatattatcaaatgaccacaggcctcagaaacattgtatacaaacactctatctgtgtgtgtgtgtgtgtgtgtgtgtgtgtgtgtgtgtgtgtgtgtgtgcgcgcgcgcgcgcagagagagagagagaatcttggttgttaaccagcctggagtgaacacgactcactgcagcctccacctcctaagctcaagcaatcctcccacctcaaccttccaagtagttgggactacaggcacctgccatcatatttagtagagacagggttttaccatgttgcccagactggtttcaaactcctggactcaagtgatcctccaaccttggcctcctaaagtacttggattacaggtgtgagccactgcacccggcctgatatatctatattttaaaaatatgtactttcataacatgtatgagaaacaaatacctcattttcttagtatataaaaatccctagcagatcaacaaaaagacaattatccaagagaaaaatagactaacaatttgaatgctttgccaccagaaaagaaatataaacagtctttgaacgtattttttaaatgtccaatctaacatataaacaatgaatatgtagattagaactatggtgaacacctttttcccctatcggcaaggccaagatcaagaagtccaatcatacttggccttggctaggacgtggggaaaccagagctcacggaggttgccggtgcaaatgacgattggtaggtacaaccttagagagcatttagacaaccagcgtcaaaatgtttaaacgcacctgccctatgactgggcgattcagttgctaagaatgtatccatcagaaatagctctgaatacatggaaagacttctgtgaaagggatactaattgcagcattgtttgttgcagaaaaaccctggaaatacctccgtgactatcaccagaaaacttgttagataaattattatattcagacaatggaatgtgcaaagaatgctctcctagtgctgatctggaaagatctgccaaggtacattgctaagttgaaaaaaacaaaatcccagtgcagaacagggtgtgtggtgtgcttctatttagagaaatgagtacaggaatccacgcacatatttgcttatctgtgttctggatgtctctgtaatgatccccaagaaatgataaccagaatggattctggggagggaagcttggagttttaaagctggggatgggggttaaggattagagggagaagacccactgtaaatcttttggtatcttttgaatttttgcatatgaatacaatcccttgttagtttttaaaaatggaactttttaatgcattgatagatgacagagagaaaaatgccttgaaggatatgctccaacgtgtcaatagcacttatctctgggtggctgatgtgaattagaagcgacttttattttgttctttttttattatttctctaatcaattatttattttgagacaagatcttgctctatcacccaggctggagtgcagtgatgcgatcaccactcattgaaacctctgcctcctgggcttaagtgatcctcccagcttagcctcctgagtggctgggactataggcacttgccaccatgcctggctgattttttatttttaattaaatttttttttgtaaagacgaagtctcactaagttgcccaagctggttttgaactcctgggctcaaacgatccctctgtttcagcttcccaaagtgctaggattacaggtgtgagccactgtgcccggtctgttctttttaaaaaatacagagacagggtctcactttgtcacctaggctagagtacagtggcataatcatagcaccctgcagccttgatcttctaggctcaagtgatcctccagcttcagcctcccaagtagctgggaccacaggcatgcaccaccacttctggctatattttgttctttttacttagattttctaatttaaaaaaataattaccagccgggtgtggtggcccatgcctgtaaatcctagcactctaggaggccgaggcaggaggatcatttgagcccaggagtttgagaccagcctgggcaacatagtgaaaccgcgtctttactaaaaatacaaaaaaaaaaaaaaattagctgggtgtggtggtgctcacctgtagtcccagctactcagaaggctgaggcaggagaatcacttgaacctgggaggcagaggttacagtgagcccagatcacaccactgcactccagcctgggcaacagagcgagactccgtcttaaaataaaataaaataaaataaaataaataattatcaaggtatattcagataatttttttaaaaattaagtaagtaaacacctcagtgttctcttggtagtcaggggaaaactaacttctacatgaaaaaaagaaaagaccaaaaacacatacacttctctaaacaggcagattattttcattgccaaggacattacagagactgaggagtgggttggaaatatattctatgaaaaatcgagaattaatacaactgtcctaccatgcactttctgggcatcaaaacgccaagcttctaactcagacctgagttcaaactctgactgccacttactagctgggcaagttgctcctacgccgttggcctcagtttcctcatctgtagtctgagaccacattgctgctggcaggctcgagtgagatcatgcctgtgaagtacttggctcaggcgtactcagagacccagttcaaacagggaacaggcagaaattctgcaccccgcaagggtgacagggcggagggaggacaggaggggccgctttgccggactggggatcagtgtgcaactagctgggcccggagtcccccacaaaccggccagctcagaggttcttccgacagtttggagagagtgacaccaagtggccaagtctgaaactacaccttcaagccggagggttagagcctctccccgacccctccagctgcggtcctgagccaggcactgaacttccctgaatctgagttttttcagctgcgaaatggaggtaatcctgcctacctggcagagcggaggtgggaattaaatgaggtaacccgcagagattctctccaggaccgccatgttgcacaacttcaggggccccattcatgaaactgtgcaacatagcggcacccctaacaggtggctgtcattatcatccctccctcagacactgagtttccttctctactcccctagagcgattctgaagctgggtcttccaaagtatagaacaaataccagtgggattcgtggggagatcttggtgggcacagcaccccagtatcaaataacatttcattctctgtcaatcattctgatggcatctaggcggcagtctcagtttgataggaacatgacattaacgcctttctaacacttacctgcctcccttccgaactttctgtttgagagtgggcctcagacttagtgccttcagaaggcaaaattatttggctagaatttaataaagttacatgttttcataatatttactttttgtggtcaccttctattgagagcaagtggtgctggttttccctttacagtagatgtggtagattgtattattgtcaaagtatttatcccattggcaattccctggtgaccctcccggctgaagtcaggcttggctgtgtgacttcctttgggcaacagagtgtgagctaagctttcgagaagcggctttgtcatgtggtttatctctgctgtgagaatggcctgccccaggaatgggctgcacctttaacctggatcagagtaaagatgacatacggcccagagctgcagtgacccacaaccaacaagtaatgagaaaataactgaggattcatattctcaatatgaataagaaatcgacctttgtcattaacaagctcctgagatgctggggctgtttgttattgcagtaaaacatagctcgagttggctgatgcagtagagttattaagtttcctttaaaaataaatatactgggccgggtgcagtggctcacgcttgtaatcccagcactttgggaggctgaggtgggtggatcacgaggtcaggagttcaagaccatcttggccaatatggtgaaaccctgtctctactaaaaatacaaaaattagctgggtgtgatggcacgcgcttgtactcccagctactcaggaggctgagacaggagaatcgcttgaacccaggaggcggaggctgtagtgagccgagattgtgccactgcactccagcctgggtgacagagcaagactctgtctcaaaaaataataaataaataaataaactggcctggtgcagtggctcacgcctgtaatcctagcactttgggaggccgaggcgggtagattacttgaggtcaggagtttgagaccagtctggccaacatggtgaaacccatctctactaaaaaaaaaaaaaaattagccaggcatgatggtgcacgcttgtagtcccagctactagggaggatgaggtgggaggatagcttgaactcaggaggcggaggttgcagtgatgagttgagattgtgccactgcactccagcctgggcaacagagcgagcctctgtctaaaataataataaataaataaataaatatactggcctgatgcagtggctctcgcctgcaatcccagcactttgggaggccaaggcggatggattacccgaggtcaggagtttgagaccagcctggacaacatgtcatagcccctgcatactcctgccctccttatcctgtttggtttttgctgctgttattgttgttgtttgttttttgtttggttggttttttgagacagagtctcgctctgtagcccaggctggagtgcagtggcacgatctcagctcacggcaagttccacctcctgggttcaagcaattcctctgcctcagcctccagagtagctgcgattacaggagtctgccaccatgcccagctaattttttgtatttttagtagacatgggattgtaccatgttggtcaggctggtcttgaattcctgacctcaagtcatccccccgcctcagcctcccaaagtgctgggattacaggcatgagccatcacacccagcctttgctgttgttttgttttgttttttgctccgtatcacctatcatcttttgaccatatttcacatttatgtgtttattttctgtatccctgtccccattagaacgtcaactccctccttaaaggcaaggattttgtgggttttgttttgttttgttttgttttccactttatagcccagtgcctagaacactgcctggcacataataggtgctcagtaagtatttgctgaatgaaggaatgagtacatgatggcaaaaggtagacaacaacggctccaggcccatgctgcacgagcttcaagtccagctgaaacacttctctttcagctgggcgcggtagctcatgcctataatcccagcactttgggaggctgaggctggcagatcacttgaggtcaggagttcaaaaccagcctgatcaacatggtgaaaccctgtctctactaaaaatacaaaaaaattagccaggcatggtggcaggtgcctgcaatcccagctacttgggaggctgtggcacaagaatagcttgagcctgggaggcagaggttgcagtgagccgagatcgctccactgcagtccagcctgggcaacagagcaagactccgcctcaaaagcaaaaaacaaaaaaacttctctttcccagtgttctggaaaaagtacagaattgaatccttggagtggagcacactgattgtccaggcctgggtcggatgcctgtatttaaatccagaagtaggctcagccccatctaaaccatgtgagctgacactgagccaggagtcttctctacaaaaactgtgatgctgttacaggggcagaggaaatgggagccaggtaggtaaaaacaatcgtcacccaccacaagaaggaggcttattcacccagctgagtgcctaggacttagtatgggtcccacgaataagtttgttcactttccttgtttccttatttggaatcaagttgtattcaggtggtggcgggggcagggatagtctgttaataccgaagataggactagaataaggggcaggcgattcaggccctccctggacaccaacatatctatggaattaaaatactgctgaaaaaaagtagatgcttagagccaaaagaaatcttggtttttctacatgtaacttcttacataatcagcaaaatattaattaacctctcttctgacactgacaaagacacccttgagaagaaatttaaaaagaaacgttgttggcttgaatctattgctgttgattagtttgtgaccccacatgtgcttattgcattatacaaccataaggcatatcacaaaccccaagaccagccaagtgggcctcctgaaattggcagtcatggtcagctaaaattctgaaaccatatggcatagtgctgttattgggaatgagtaatctattttgttccagaatctaaattctaagctctgtaataatgcctccagttgtagagtctgagagttgtccccagtatcagtttttcccttctatagaggtaaatgctccgtggaaacacatggctggttgcagtaaagactacatttcccagcctcccttgcagcaagaagcggccatgtgactgaggtatggccaatgagatgtgagcagaacatgggacagcaaacaaggtgatcagccatttggacctctggatggggtccacatgctggtgagaatgggacaacaagttaggggcccaagcctctgacaactttctggtacagagccaccgcccagctcagacatccctgtgaaaaacaaataaacgcttatcatatttcagtctcttattttatgtctctgggccccacagacgaaattatgttctaataatacacctctaaagaagttggcctggcatacataaataaagctcttcctccttcttcttttcttctttttcttcctcctcctcctcctcctcttccttctttcttcttctccttctcttccttcttctccttctcctcctccttctccttctccttctccttcttctcctccttctcctcctcctcttcctcctccttcttctcttcttcttgattcttcttcttttggtttgttggtttttttgaaacagagtcttgcttgacacccaggcctgagtccattggtgtgatcatagctcactgcagccttgaactccttggctcaagtgatccaccttggcctcttgagtagctgagactataggtgtgcaccaccatgcctggctaattttctttgtaaaattttctttagagatgtagtctcactgtgtttcccaggctggtctcaaactcctggactcaagtgatcctccctccttggcttcccaaagtgcctgggattacagatatgatccaccgcacttggccttcttttttttttttctttaacggaagtatacaagtttgattcacttatatcagtttattcctgttcaacaaatacttaagaccatctaaagatgcctgccaaggaggcccctatgttatagcggcattaaaaaaaataacaaaaactgggccaggcacgatggctcacatctgtaatctcagcactttgggaagccaaggtgggaggattgcttgagcccaggagttcaagaccagcctggacaatataacgagacctcatctctattaaaaacaaataaataaatgaaacctactctttggcacctttaacttaagtcctccagggagctggtttccaaagctggctgactatcagcagcatatggggagtctttttaaaatagattcctggaccttggccagttcatttgaaaagcaggatattggaaatctgtaattttaaaaacactccccttcctaccagctgtgtgactttgagcaagtcatttaatttccgagtgctgccattgcctcatcagtgaaatggggacaataatcgtacctaccacataggtctgttgtgggcatgaatttatttcatatgtgcaaagcactgagcatagtgcctggaacagagcaagatctctgtgtgtgagttatcattatgtctgttggtgggagtatagattaatgcaaactggcccggtgcaatggctcacacctgtaatcccagcactttaggaggccaaggtgggaggataacttcagcccaggagttcgagaccagcctgggcaacatagctagacctcgtctttacaaaaaattaaaaaaaaaaaaaaaatagccagatgtggtggtgcatgtgtgtggtcccagctacttgggagcctgaagtgggaggatcacttgagtctaggaggtcaaggctaaagtgagctgtgattgtgccactgcactccagcctgggtgacagggtgaaaccctgtctcaaacaacgtaaaacaaacaaaaaaaatgatgcaaactttctggaggacagtttgtgctatctaccaaagtattaaatatgtacccagcaacatggtagctcatccagggcacaagaatgatcattacagcttacatttattcaacaagtatttattgagcacctactacagtactttagtcagaataaaataggctatactgcagggacaaagccagcgttgcagtgacttaatacagcaaaggttcatttcttgcttttgcattatgatacaaattgagtacttttctccatctggaacaggctgatgcaggtgaatcccaaaatcagggctcagcctgggagggttcttggcttcactcaggaaagaattcaagagtgagccaacagtgaaagaaagcaagtttattagagcagcagtgtgcagcagaggggctgctccgtagacagagcagggctactccataggcagagcagcccagaacagcagcaaagaccacagcccagagcagtagtccttgcagaccagggctaccgatatttatacccactcttaattatatgctaatgaaggggcgggttattcagaattttctagaaaagtggcagagggttcccagaactatataaggtaacttccaggtcattgccatggcatttgcagactgtcctggtgctggtgggagtgtctttatgctatgagcagtgagggcaactagaggtcacttttgtcaccatctgcttgtttcagcgagtttctttactgcatcctgttttgatcagcagggctgtgatttgtgcttggaaaataagtcctactgatctcctacctcaccttctttatctggaaaaggaagtcttagagatgaacactgtaggcaaagagagagctagaaggtaacatggaatttttcaacggccagacctgaaagtagcttccatcacttttgcatatcccattgggcataaatgagccatgtactttcaaccttactgcaaggaaggctgggaaaggtagaggagcatgtagatattgagtgaggggtgtctttgtgacatctactatgttcaaagacagtgctaggagctggggcagtcatgggggagcaagaccaacaaggttcctgccctcataggtcctcccttctaatgagggagatagacaataaacctctgctctaaacatgatcccagatatatgtcattttgcacttgagcaagaatatctgatggatacattttcagaatctgtggctgctgcgtcaaagggtatatatatttgtcatttcaacagatatggtcaaattgtcctccataggactgtgccaatttccacctccaccatcaaggtacaaaagtgcttttttttgcctgcaggcttgccaacacagtgtgttatcagacttttggatttttgccaatctgataggcgagaaatgatctctgtgtacttttaatttgcatttttcttattataaaggaagttgaacatcctttcacatgtttatgagctatttgtatttccttttctgtgtacttgtgtgtacatatccctcatccattttcctctgagtcattgattgaggatattactaaatgaaaaagtgaagggacagaacagaatgcatagtagaatcatttttgtaaatgaaaagtgaaacaatatgttggcatatacatataaatatactcgcataggcataaaaattttctagaagcagccaggcgcggtggctcacgcctgtaatcccagcactttgggaggccaaggtgggtggatcacttgaagccaggagttcaagaccagcctggccaacatggtgaaaccctgttcctactaaaaatacaaaattagctgggcatggtggtgcgcacctgtaatcccagctactcaggaggctgagtcaggagaatcacttgagcccaggaggcggaggttgcagtgagctgagattgcgccattgcactccagcctgggtaacaagagcaaaactccacctcaaaaaaaaaaaaaaaagaaggtgtaaacaactacagatgtccaccatgaacacctcctgtgtgcaaggcactgtggaagctgctgggaatacaatggtgaacaagatgtgtgtggtccctgccctcaaggagctaacatcttagagggtgagagaagaagggcaaattaacaaatgttttaggtcaggcgcggtagctcacacctgtaatccgagcactttgggaggcctaggtgggtggattgcttgagcccaggagttcgagaatagcctggcaaaatggcaaaaccccatctctacaaaaaatacaaaaattggccaggcatggtgatgcatgcctatagtcccaggtactggggaggctgaggtgggagaatcacttgagcccaagaagttgaggctgcagtgagccatgatcatgccactgcactccagcctgggcatcagagcgagatcctgtctcaaaagaaaagaaaagaccaacaaatcagtgggaaaatggtcaaaaaaagatcaaaaagaggaaaaagcaaatggctcttaagcataccaaaagatgctcagttttggccaggcacagtggctcacgccagcactttgggaggccgaggagggcggatcacccgaggttgggagttcaagaccagcctgaccaacatagagaagccctgtctctactaaaaatacaaaattagccaggtgtagtggtgcatgcttgtaatcccagctacttgggaggctgaggcaggagagtcgcttgaacccgggaggcggaggttccagtgagccaaggtcacaccattgcactcctgcctgggcaacaagagtgaaactccgactaaaaaaaaaaaagctcaattgcatgtataaaaagagaaatgagataccatttcctaccaccaccccgcccccaccattgcactggtttaaccaaagtctcaaattgacaatccactgtgttggtaagggtgtcagaaaatgagcacacgcaaactgatgcgactccacatgaagaggactttggcattattcattaagtttaaaatgaccatagctgttaccaaggcaattctgcttttaggagttcatcctacagatttattcacacacagcatggacgcataacattttaagggaatggggaggaacagaatatatattcacatttgcttgtacatgcataaaccatcttagaaagatatgcaatggactaataactgattgtgggaaggaacagcatatgcaaaaggccccaagctgaaaaagaggttggtgtatttcaggaactaagagtgtgcctgggaaggatgacatgtgacaagtggtggcctgaggctgctgagccttgtagatcaccacttaggagtctggtcttgagtccaaatgcagtgggaagacattcaaaagaagatgatctgatttccattttaaaagcatcttgctgccatttggagaaactactggaggaaggcaagacgcaagtcaggagactgattagcaggctggacagttccctgagggagggacagggagcgggtggctgcacctgagaggtggcagtggtgaaaacgagcaggcagattgaagacagtttgaaattgcaatggatgagttggatgtggcccaggaggggtaacagagcagactcaaggaagactcaaggctgaattctggcttacgtggccacatgggtggctatggaggctactgggctgggaaggctagagaaaggggcccagatttcgcttgggtaccccagggtggggtgtgttaaggttgagaagtcaataaacatctgagtggcaacttccccctctctctccacttccccaaccccgcctagggtcatggtgagggtggggagtgggaaaagggcagggcataaaaataaaaaataaaacgccaggcacgatggctcacacctgtaatcccagcactttgggaggctgaggtgggcagatcacttgaggccaggagtttgagaccagcctgggcaatgtgatgaaactgtctctagtaaaaatacaaaaattagctgggcgtagtggtgtatgcctgtaatcccagctactagggaggctgaggcagaagaattgcttgaacccgggagacagaggctgcagtgagccgagatcgtgccactgcactccagcctgggcaacagagcaagactctgtctcaaaaataaaataaataaaataaaataaaataaaataaaataaataaaataaaaatgttcatagcagctttattcataataactcaaaactggaagtggcccaagtgttcaacagcagaatggataaatgtttactatccacagcagaatggataaatggataaatgtttactatatatatatatgtatgtgtatatatgtatgtatacatacaaatatattacaaatatacaaatatattatttaatctataatctgggaagtctactaaaatagtctaaatatattattagtatacattattttagtgtgcatatgtatatatatacacacatatattaaaagaatgaaaatgaacaaactactgatacagcccacacaaatgaatctcacagacattctgttgcgcaacagaagccagacaccaaggagtacatattgtctaatgccatttattcattttatttatttatttattgagatgaagtcttgttctgttgcccaggctggagtgcagtggcgcgatgtcggctcactgcaacctctgcctcccaggttcaagcaattctcctgcctcagcctcccaagtagctggggctacaggcacgtgccaccacgcccagctaattttttgtatttttagtagagacagggtttcactgtgttggccaggatggtctcgatctcctgacctcgtgatccgcccacctcagcttcccaaagtgctgggattacaggcgtgagccaccgtgctcggctgtctaatgccatttatatggacttgtagaatcagcaaatctaactcgtgatgaaagtaaaaactgagaaaccaagtttcctggaagcacaaaaggcaaggcaagatctattttgaagcaagctcagagtggcagcagattatgtaggggccacaaggcagcctttaagctgcacctcaaaaatagcatctgtcccctggatattttaagagtgtcctctgcagggcatggcaggagccagaggcctgtttgggcatctccaagcgtgcacctaaagaatgtatcatctggccgggcacggtggctcatgcctataatcccagcactttgggaggccaaggcgggtggatcacctgaggccgggagttcaagacaagcctggccaacatggtgaaaccccgtctctactaaaaatacaaaaattagccaggcaaggtggtgcatgcctgtaatcccggctgctggggaggctgaggcagtagaatcacttgaacccaggaagtgaagtttgcagtgagctaaaaaaaaaaaaaaaaaaaaaggaatgtatcaccccgcctccccttgaccctgagcaccacccggctccaaagctgtgtcagcagcaatataaaaggtgcagagataaagagagacatttaattagaagatgatttgggaatcatcttctaatttaggaaccaagctgcaaaatatctttctcccttaatggcacaaatggggaatttggactttgaaccttttctcttgtcaggccaccaaaaacgtcttcctgtattaatagaaggcaaatgtaaggattcagggccaggagggctgtgggctgtgggtcttagattgtctagagtcagaacattaagaacatgagagccctttctggacctctttgtttatgcggggcttctgctggggcttataatcacctcatcactgctgctatttttgcagtaattattaagtactttaatacgtgcacagggcatgtgcagtccttcaattacactgctcctgcctcattgtcgggaggcgagttggaattgttctccttgttttgcacaaaagaaagcaaaggcctgggtgaatgaacaagttcagggtcaaaaatgagtcagcacaagggagatggcaggaggtgggtgggaacccggcagtccctagttcccgcccagcttgaagtgctagcaggtctaaattcaaggcatgtgccacatccttgaagaagtgatcgacggccgggcgtggtggctcacgcctgtaatcctagcactttaggaggccgaggcaggaggattgcttgagcctagaagttcgaaatcagcctgggcaacatagtgagaccctctctaaaaaaaataaaaataggccacggatggtggctcacacctgtaatcccagcactttgggaggccgaggcaggcagatcacttgaggtcaggagttcaagactagcctggccaacatggcaaaatcccatctctactaaaaatacaaaaattagctgggtgtgctggcgcatgcctgtaatcccagatactcgggaggctgaggcaggagaattgcttgaacccgggaggcagagattgcagtgagctaagattgtgccactgcactccagcctgggccacagaacaagactctgtctgaaaaaaagaaaaaaaaatcacctggttcatagtaagatgtcattgttaattttggaaggtgtgctaatagcatggtggtttcagaaaaaaaaaaaaaaagaacaacttagtatcaactactggtgaagtgacaaaaggcttacgatgaaattgacaaaatgaatgtggataattgctgaaggtggatactggagagttagttatatgactctatttttctagatgatgtttgaaattttccatagtacatgttttgaaattgtatagactaaatgttgcaaacttgtatcttatgggtaaaatgctgctcacaaaaatcctgtacctcctttagatgggtccttggctctcagtgtgccacagtccccacccttccctattatagcctgacactgttcatcatcactcttgggtcactgtttttgtttaagtagaattaaaaggaaactgaatgagttctcttggggcaagactgttatttgccatccatatgtccaacctctacttctttcttacttatagaaactcctacactattggcaatgaattttgaaataacatttcccagtttctcttgaagctaagaattgcccagtgtttctcagtcagaggtgattttgtcccccagaggacatctggcaaagtcttggaagacagttttggttaccacaacaggggcagggagggaggcagggagtgctctactgatatctggtgggtgggtagaggtcagggtactgctagacagccctccaatccccaggtctccctcccacaacaaagaattatgcagtccaaaatgtcagtagtgcccgattgaatggccaatgcatgataagtggaagttgatgttggggtttccaagaaagccctttggtgtcttgccaatcttcctagaatataaacatgatggctggagtttgagcagccattctgtgaccttgaggagggaggttctatgctaaagatggaaggaaatgggatccccgaaaacatcatagaattgccatatctgttctttggaatgcagattttcagacatggttttatgtgaaagaaataaatctctaatatgtttaagtcactgaaatcaagtctctgttactgtcagccaagtgcagtttctaaatgatttgtctctgtgcccagttctctatgctaatggagaaaggaaagatagactaagagggccatatgtttaaagaaaaaaaaaaaaaaaaggcctgggacatgctggctcttgcctataatcccagcacttcgggaggccgaggcgggcagatcacctgaggctgggagtttgagaccagcctgaccaacatggagaaaccccgtctctactaaaaatgcaaaattagctgggcatggtggcgcatgcctgtaatcccagctactcgggaggctgacgcaggagaatcgcttgaaccaggacccgggaggcagaggttgcagtgagctgagatcgcgccattgcactccagcctgggtgacaagagtgaaactccgtctcaaaaaagaaaagaaaaagaaacgagaaaatacgtttcttcacaacaatgaaacagttcattgccttcatttatgtcacttcttgatccctgtaggcatttgagtttgcaactcctggactggtccttaaccaaaaagatgaggaaactgaggtcctcagcaggttaatgatgagttaggagtgaatccacaacctggtccctctccccgcatttctaaggtaccaaggcctacgcactggcgaagaatatggtttctgcagccagacagacgttggttcaaacactggtactgacacaggaaaagttcccttatcctcctcgaagggcatgcgatgggggtgtggctcacttcctcagtgcttcgctgctcaaaacccctagggggagcaggcagacgggcagggtgtgggactctggccacgcagcgtctaggcgtgaatgtttacagctcctgaggccccagtgggcgtgtgttccagggtgctcttttcgtttaaccgtccatagacagcttgtgttagctcaattagaccccttgccttatctcaaggacagagggctatctgtatcctggggtttcttgccttggcgtacctgaagaactggatcacacgtaggcttggagaatgaacgcaaggttttattgagtggaggtagctctcagcagatgggggagccaaaggggatggagtgggaaggcgattttcccctggacctgggccgctgagtggcccaggctctcctcccaccaccccagccaaactccaagttgttccaccggtcgatggcctgctggcatctgccggtgcctgatggtgtgctctcatgccagttccttcttctccaggtctagttgcttgtgtcttttttttttttttttttttttgagatttagtctcactctgttactcaagctggagtgcagtggcatgatctgggctcactgcaacctctgcctcctgggttcaagtgattctagtgcctcagctgggactacaggcacctgccaccacgcccgcctaatttttttgtatctttttttttttttttttttttttttttttttagtaaagatggggtttcaccatgttggccaggctggtctcaaactcctgacctcaagtgatctgcccaccttggcctcccaaagtgctgggattacaggcgtgagccaccgcacctggccgtcgcttgtgtcttcttccaccagtgcgttcttcttggcatccagccacttgtgtctctgcctgctagggtctgggggtttctataggcataggatgggggcgtggcaagccagggtggtcttgggaaatgcaacattcgtgcaggaaaacagaaatgcctgtcctcacgtaggtccgtgggcacaggcccaggggtgaagccctacccagggaccacgcccttcccttcccagcacttccctgcccccactcccgtatcagtaccaccaattactagctctgtggctttatgcagctcacttagcttctctgtctctcagtttctgatgcgtaaaacaaggatgacaataaaggcacctattgcctagggccattaggtggattcacatcagtccgtgccctggcaggaggagagttttatgaatggactgtctataaaatgtaggtggggaccgtccatttctccaacagctgggaaggatgttggtgttgaagtttacacacctatcaaggacagtaactaccatggcttctggtgctttgacaaaacctccaatgcatagccttctggttaagcgtctgtgatttcatattattggagcattcatggtatccctggtggttgcagctttctacaagattgctatggccgaaccaagaaagaaggcatacgcagatttctacagaaattatgattccataaaagattttgagatgaggaaggctggtatctttcagagtacaaagtgatcttggaatatgaagaatttctttgagttgaaatatctagaagtttgtcactgacttgtgttcctgaactatgaaacatgaatgaatatgtcagctaagaaatagtttctcttggtcaggcgtggtggctcatgcctgttatcccagcactttgggaagctgaggcgggcagatcgcttgagatcaggagttcgagaccagtctggccaacatggtgaaaccccatctctactaaaaatacaaaattagctgggcatggtgggcatgcctgtaatcccagcttcttgggaggccgaggcagaagaattgcttgaacctgggaggtggaggttgcagtgagctgagatcgcagcaccgccctgcagcctgggcaacagagccagactgtctgaaaaaaaaaaaaaaaaaggaaaagaaaaaagaaagaaagaaagaaagagtttcttgactaggtgtggtggctcattcctgtaatcctagcattttgggaggccaaggtgggcagatcacgaggtcaggagttcgagaccagccaggccaacatggtgaaaccccatctctactaaaaatacgagaaataattagccaggtgtggtggcgtgcgcctgtaatcccagctactcaggaggctgaggcaggagaatcacttgaacctgggaggcggaggttgcagtgagccgagattgtgccatcattgcactccagcctgggcaatggagcaagactgtttcaaaaaaaaaaaaaagaaagaaaaaaaagaaaaaagaaatagtttctcttgataaataaacaattaacaacaacaataacaaaatgtaggtgggatttacagaacccagggatgctgcatcactccagcgatagtaacaaagggagtttatcacagctagatagtaacagaggggtccttagcacccccacatagtaacagtggcctggaggagcaaaggaagaagtggtctccaggtccagagagagggagctctacagagaggctacctgacagaagctgtgtcatccttcagtcaagggacacagtagaccatggtgacccaacaggagagctgggggaataaacagctcctctggaattgagatgttcagttagccaagtgcatttgttagctgcccaaccactctaagctcacgaggagcaagagaaagcatgccttcttagtagctactaaacaaatcctgagatgaactctgattgaaccaatctgtgccacatacccatctctaagccaatcatcgtagtttttttgtttgtttgtttgtttgagacggagtctcgctctgtcacccaggctgcagtgcagtggtgcaatcttggctcactgcaacctccacctcccaggttcaagcaattttcctgcctcagcctcccaagtagctgggattacaggctcccgccaccatacccggctaattttagtatttttagtagagacggggtttcaccatgttgtccaggctggtctcgaactcctgacctcaggtcatccccccgcctcagcctcccaaagcactggattacaggcgtgagccactgtacctagccaatcatcatagttattgtacctccactgctctggttcgttggtgctaagtcacatgctccttgttgggttacaggctcaagggaacttcctgatggagcgaacttccagaaggggtggttcccaaatggaaactcaggttacttggcatggaagagagtgccgtagattcagggtggccccaaatcagcaaacattcattatattcacgttataaaatgaaagaacattcagaaaacagcataaagtagcatgataccattggtaggcactgtgggatttcccatcagccatcctcaaaacttatttttggcaaatgaaagtgttggactagggtaactcttccctgccaacattcaacatgtgtgactatccccagaaagtaactacgtaggaacaagaacatgagatgctcccagctggagccccaagggccatttccaaagctaccaacagagcgtcctctgtgtttcagtaagggtaactttctgcaaaatacaacaaagatgttcatgtgaaataaagggggtgatttatgtatgaaaaggtggggtgtgagccttgtgaataccatgggaagatgaggtccttccactcagggaataggagccccgtggtttggccccagatggtaaacaggagtgctgtttagttgaagaacagcatgtcccattctgttcttttggggagatttaaagcaagaccgtttgcaattggatctaattgataagtgtcttagtttggaatcccctgttggcacacctcatatcttagtttagattctctagatacagaccctgagacaaagactcaaggacacatcacttctttggaaggcaaaagaaatacgagtagagaagaaaagagacccagggaaaggaggacaaccaatattaagcaagttatcaagacagttactgccctaggcaagtgaagcttaattccacctgtgtagaacacatgtctcagagttatcttacctgaaggatcagcaactccatcttggaagctaatccgccatgttggcttctgattaacccctgttccaagaaggcctctaagatttctagtttatctattattccttgtgtaagagcaggttctgactctatatcctgtccttaggtcaaacaaccttgatgttatcttacttcaactgttctacacatcccttctgaaccacccctctcctatggtatagaagccctgggtctgggagataatggagtggggatccaccatcttgtctggccaccgcaggagacacagacgtggcatctgtttctaagtttctattaaaagtttctttctaaggaactgagtatgtcagcatcatctcttcagcctctcagcttccttggactttggggtaagtttgcatagacctgcccactgcaaaacaatcaggaagctggggtatttatacaccacctctatccattccttggttgaaggcagctggaaagaagagaaggaatattcattctccaacctcctttaggctgcttgactctgacaaccagaagaaaaaacccaaaaaactcatagaaaaagatgcacatactaccagttagaagttgggcagttggccaggcgcagtggctcatgcctgtaatcccagcactttgggaggctgaggagggcggatcacctgaagtcaggagttcaagaccagcctagtcaacatggtgaaacaaaatacaaaaattagccgggcgtgacggtgggtgcctgtaatcccaggtacttgggaggctgaggcaggagaattgcttgaacccgggaggcagaggttgtagtgagccaagatcatgccactgcactccagtctgggcaacagggcaagactctgtctcaaaaacaaacaaacaaacaaaaaaaagagctagttacctttatgggcaactggggcacagtcccagaggggccctcaggggatgatgtggagtataccgcaagattgtctcaggaagggttggggaaactgtgctgtttatccgcaatgaccactctcagcggttgaaggtggtgcccggggccagcaactccagtacacttcccttcccacacatgtgacctgccatgcgcacatgaagcacacaggctctgggcagagagatgcgggtgccggaggttgggtatacgtcaccagcatttatagaactgtccatctagcttcaggcagctctcttgagtgggctgaggaggatgagtgagcactgatgctggccaggaaacttaggagaaggaggggaaaggaagaaaggaacaaaactaacatttataaagtgcagggtagttgccagccattagcacagttactttcgttttctgattcccattgtacagttgagaaaaacgagctcagagagggaaagtgacttgctcttgactatgtgacagttaagtgctggaattccagctcagattgagtctacaaagacagtgttctctatctccctcttccttttctccttgtcctcctcttctctgcttttctctccctctccctcctccccaccaccttgtttattttttttccaaataatatttagagttaccaagacagaagtcaagaggaaagctttctggtgtccttaaagatgtgctttatgaaagatagttttcatttgctcttttattcatttgacacatttattaagcacctatgatacgcaatatatagaaaacaagacagacacaatccttgccccttaggctttatactctagcaggaaaaggaggcattaaacagctaaatacacatggcgaggagggggtaagggaagcctagatggggaagtgggggagtgagatgggaacaggaaggcagccataaaaagcaattagttgattacgttgtgatacaggtttctcaacctccgcattagtgaaattttgactggatcattcctgtaggctgttctgggcattgtaggatatttagcagcgtctctggcctctacccactagatgccagtagcattcttaccctggttttgacaaccaaaaatgtttccagacattgtcaaatggcccctggggggcaaaatcactcccagttgagaaccactgtggtaaataagaaaggcagatacgaaaacatgtaacaaggaaacagaatctaggcatacccacaaggaagtgcctttaggacgagatccatgtgacaataggcattagccaggcagaaagcaggaatggcatcctaagtagagtagacagcatgtgcaaaggccctgtagccagacctgaaaggatactggagaacagagagtggcctggtgaaatgggcagggctcagttcacacagggccttagagtctgagttataaattttagcctttatccatggtcacttttccttttttttttttttttttttgacacagtttcagtcttgttgcccaggctagagtgcaattgtgcaatctcagctcactgcaacctccgcctcccaggttcaagcaattctcctgcctcagcctcccgagtagggatgtgccaccatgcctggctaattttgtatttttagtagagacgggggtttctccatgttggccaggctagtttcaaactcctgacctcaggtgatctgcccacctcggcctcccaaagtgctgggattacaggcgtgagccaccatgcccagccacttttacttttaaaattcatttcagcatggttaaaataataaaaataaactaaatgacaacagacaacatcaagtgctgactaagatgcagagcaactggaactcccatacactggtggaaatgcacaacggtagagcttctttggttgtttttttttttctttctttctttctttccttccttccttccttccttcctttcctctttctttctttctctctctctttctttctttctttctttctttctttctttctttctttctttctttctttttttgagacagagtcttgctctgttgcccaggttgaggtgcagtgacacaatctcggctcactggaacctccacctcctgggtacaagggattctcgtgcctcagcctcctacagtacagcttctttggaaacagtttggcaggtttgtttgtttgtttgtaaagttaaacctacggttatcatacaactcaccaatcctggccaggcatagtggcttatgcctataatcccagcactttgggaggccaagatgggaggattgcttgaggtcaggagtttgagaccagcctggtcaacacagtaagaccccgtttctataaaaataaataaataaataaataaataaataaagtaaaaatcccacttttagaaatatacccaaatgaaataaaaactgtttatttaataaaaacacaaaaacctgtacaagaacgtttatagtggctttattcataaaggccaaaatatgggaaaccatctaaatgcccctctactgaggaaagattgaacaaacggcagtacatctgtacaatggaatactactcacgagtaacaagatgagaactctttttttttttgagatggagtttcgttcttatcacccaggctggagtgcagcagcatgatcttggctcactgcaacctccacctcccgtttgcaagcaattctcctgcctcagcctcccgaatagctgggattacaggtgcccgccaccacgcccagctaatttttctatttttagtagagacagggtttcaccatgttgaccagggtggttttgagctcctgacctcgggtgatccacctgccttggcctccaaagtgtggggatgagaggcatgagccatcgcgcccaggtgagaactcttaatacacacgatgatgtagatgaacctccaaagcatcatgctgaattatagaagccagactcagagggtacatgttatatgattccatttatatagtcttttgaaaaagggacaactataggaacagaaaacagttaagtggttgccaaaggctgggagtgggcacaagggtagactacaaagggtccccaggaaattgggaagacaattaatagaatggttctaaaccttgactgtggtggtggttagatgactgtgcatttgtcaaaaaatacagaacccagtcagccaggtgcggtggcttatacctgtaatcccagcactttgggaggctgaactgggcaaatcgcttgagccgagaccagcctaggcaacataatgaggccccatctctacaaaaaatagaaaaaattagttaagcttggtggcgcctgcctgtagtgcagtcccagttacttgggacgctgaggtgggaggatcgcttgagcctaggtggttgaggctgcagtgaaccaagactgcaccactgcactccagcctgggcaacaaagcgagaccctgtctcaaaaaaaaagaaaaaagaaaaaaaatcacagaactgtatactagataggatagattttactgcaggtaaataatgcctttattttttgaaagtaaaaagttattataatgaagactctacagtaggtctatcagttgcacatttggggggaaatcaagctgggttctggttcaaggaaaaaattaagaaaggtaagaagaaaaagaaaataaattttaaaatctaaaaagaaaaagaaaatagtccgcgtgtggtgactcaggcctgtaatctcagcactttgggaggctgaggcaggcggatcacctgaggtcaggagttcgagaccagcctggccaacatggtgaaaccctgtctctactaaaagtacaaaaattagccgggtgtggtggccggcgcctgtaatcccagctactcgagaggcttaggcaggagaattgcttgaactcaggaggcagaggttgtagtgagccgagattacaccactgcactccagcctgggtgacagggcaagactctgtttcaaaaaaaaaaaaaaaaagataaagaaaaagaaaataaatcaagcttggtaagaactatgaggtaaatcttgactcccggggggactcgggtaacaggaagctagatggtggtcatgctcaccatttgaaccacatgtacctatgagcaaacgaaagaaagataaggcaatgcagacatttggtgctggttgacaggaatgactgttttccagcacatacaaaaaagattgttccaaacaggtaaatgcaaaagcactctggggaaacagtgctgggttccacacttatcttcgtgagctcagctcatggatagaccaacctgcaggaggaggagaaacctcaactgagcagaaaataatcctcagactcttggccatcttcagagtagacatgtgtttaatcttgactccatttcaggagctttgcagattttctataaatgtatcatgaaaattcaatctcaaaaacaggaggttgacataacagtgaaaattcagtagatcttcaaagctacatctggcccatccaaaccccagatcaaacttggatttcatctttttaaatgaaactctttggtgtcaatatcaataaagactgtctaagcctggcacggtagctcatgcctgtaattccagcactttgggaggccaaggcaggtggatcactcacttaaggtcaggagtttgagcccagcctggctaacatggtgaaaccccatctctactaaaaacacaaaaattatcgtggtgtggtgtcgggtgcctgtaatcccagctactggggaggacgaggcacgagaatctcttgatccggggaggtggaggttgcagtgagccgagatcatgccattgcactccagcctgggcaacagagcaaggctctggctcaaaaaaaaaaaaaaaacacacacacaaaaaaacaaaaaaactgtctggtgagtcaatgacccttgcaatttcaaaactgcggttttcatctgatggctggtgggacttccacagaactcacaatgttaattccagaaaaaaacaatgaaaaaaaatagcaaatgacagaggcatagaccaatgtctgtatgtttatatgagtcccgataaatccgatataagtggtgtttttaagtacaaccataaatagtacggctagcacgtgtccctctggctctgcaagtagcagctgtgaggccagaggaagtcccttcatctctctgagtaccagcgctctcatttctgaaatgcagatggtaataggacctgtccctcagggcagccgtgaaaattaaataagatgatgtgtgtaaaatgctcaataaggtgatatcttagttttctattgctgctgtaagaaattaccataaatttagtgaccgaaagcaacacaaatttattatcttatagttctggagtccagaagtccaaaaatgggtcttgtggagctaaactcaaggtgttggcagagctgccttgcttctgtggaagaatctgtttccctgccatttccagcttctaaaggccgctcgcattccttgactcgtggttggtccatccttcatctttaaagccagtggcatagcatcttccagtctctctctgaccctgctgccttcctcacatggccttctctgactttgaccctcttgcttcccttttataaggacccctgtgattatactgggcccactgtgctaacctagggtaaccccccaccacccatctcaagatccatattttaatcacacctctaaagccccttttgccatataaagtaacattcacaggttcaagggattagggcacagacatctttgggggagaccattattcagtctaggtagctcttatatcttgctggttgtaaagacgctatggccatgtagaataataatgatgacataaaagtaaagaaaaaagagatgctctcaaactgctggattgaaagcttgcatgagaataaaatactggaagaatacacaactaaatgctgattgtgattagagttaaatccgtgtaaccaggggtgtttgttttttttccaatttttcatgatgcttttttattacttttataataaaaatatttttaactaaaatattagtaatacagtggatgttcatcccctccaaatctcatgtggaaatgtgatccccagtgttggaggtggggcctggtgggaggtgtttgggttatgggtgcagatccctcatggatggcttggggccctccccatggtaatggctgaattctcactcagttcgttcactcaagagctggttgtttaaaagagcctggcatctctcttgcttcttctctcaccatgcgacatgccttctccggcttcacctcctgcagtgagtaaatgctggcactgtgctttctgtgcagcctgcagaaccatgagccagccaggtaaacctttcctttataaacaactacccagcctcaggtattcctttttttttttttttttttttttgaggcagggcctcactctgtcccccaggctggagcagtggtgcgattgtggcttatgcaacctccacctcccaggctcaaacaatcctcccacctcagcctcctgagtagctgggacttactggtgcatgccacctgtattttgtatttttagtagctactttttgtatttttagtagagaaagggtttcaccatgttggccaggcttgtctcgaactcctaacctcaagtgatctgcccccttcagcctcccaaagtgctgggattacaggagtgagctaccccgcccaactaatttttgtattttttgaagagatgcggtttcaccatgttgcccaggctaggttttcctttatagcaatgcaaaatgaactaatacaattagtaaatatgaaaatagaaatatctttattttatatgtatattatattgatgtatttttctggttatcaattgctgcatgacaaactacctcaaaacctagtggcttaagccaggtgtggtggctcacgcctgtaatcccagcactttgggagccgaggtgggcggatcgcgaggtcaggagatcgagaccaccctggttaacacggtgaaaccccgtctctactaaaaatacaaaaaattagctgggcgtggtggcgggtgcctgtagtcccagctactcgggaggctgaggcaggagaatggcgtgaacctgggaggcggagcctgcagtgagccgagatcatgccactgcactccagcctgggcaacagacgtaaacaccgtctcaaaaaaaaaaaaaaaaaaaaaaaaacctagtggctagtggcttaaaaacaacaattatttataccactcacagttctatgggttgacagcttagctgagtggctctcacatgggggtctctcatgcagttggctactggagcaggaagtccagaactgacccagcatcatttccactattttctattggtcaaaacagtcacaaggtcaagcccaggccaaattcaagggggctgaggattagaccccctatctcaaggaggagtggcacacacatatggggagggaaggaattgatgacagtcatctctaaagtcaagctaccaggctggccaacacagtgaaagcctgtctctactaaaaatacaagaattagctgggtatggtggcacatgcctgtgatcccagctactcgggaggctgaggcagaagaatcacttgaacccgggaggtggaggttgcagtgagtcaagatcgtgccactgccctccagccttggcaacagagcaagactccatctccaaaaatatacacaaaaataataaagtcaagctaatatatatcatactgtccctctccccacccctcccccatatcattccaggatgtctccctcttctttgtaaggaatgtcactgaggaagttcatcccagttgaggtgggcttttttgttgttgttgcttgtttaacatccgttccacttcccatgccagtatcccaagcttcctgtggaggagcttcaggtcaaccacagtgccttgtcctctactattctgtaaatgggtatgtaacccaggccaagccaaacaaaccctctctgaaatttcaatctcaaacagaatgacaaaaaaaagttctgaaagaaagtttgcagtggaaactgtggatgactctcaccaggctattatatcccaggagcagggatgtgcctgatttgtctaagccaaggtttctcaatatcaggactgttgatatttggggagagttcattcttttctgtgtgcaagggatgggaaggagctgtcctgtccattataggatatatagatgcagccccagattctacccacgagatgccactagcacctctcctagttatgataaccaaaaatgtcttcacacgttgtcaaatgtcccctgggggccaaaatcatcccttgtgcctcttgctgatgattggttcaggagtgaacaggcccaagccagttttgcccaataggacaccaggggagctggctgcagtggcttacacttgtatttccagcactttgggaggctgaggtgggaggatcattgaggccaggagttcaagttcagcctgaacaatatagtgagaccctgtctctacaaaaaaaaaaaaaaaaagttttaattacctgggtgtggtggtgcactcctgtagtcccagctattcaggaggctgaggtgggaggattgcttgagcccaggaggttgatgctgcagtgagccatgatcacgccactacactccagcctgggcaacacagtgagaccctgcctcaaaaaaaaaaaaaaaaaaagacaccaggatagatttcttggggacttctggcagtaacatttccttactctcaagagagagctatggggagacactccctctctttcgcactggatgatttagcaaatgatcttaccgtcataatcactactggcagcgtgccccgttttgcagccacagggaaccagttttcagataaagccaacacatggatagtaatgggaagaaagagagagaaccctggatctcaattacattcttgaacctctgaatcaaccaaccttggtgttgcccttcctacaataaactcccttactgcttaagccaggttgagttgagttttctgttacttgcagccaaagcgtcctgagtgccgcaccctcagagctgaagagcacactcgtgagttgatgccagcaagatcccccagcgcatcatgtggccaattctttctaaacttggtttcagagctttcttgctccatttctaaaaagcaccttatatccttctaacaaattccttttctgtttctgttggtaagaaccagtttctttttccttctttctttcttttcttttttagacgcagtttcgtccttgttgcccaggctggagtgcagtggcgccatctcggctcactgcaacctccacctcccaggttcaaccgattctcctgtctcagcctcccgagtagctgggattacaggcgcccgccaccaggcccagctaattttttgtgtttttagtagagatggggtttcaccatgttggccaggctggtcttgaactcctaacctcaggagatccgcctgcctcggcctcccaaagtgctgggattataggcatgagccaccacacccggcctgaccagaaccaatttctgtgatatgcaatggaagaattctgttacctcagttggctaatttcagcaaaaagccccaacattcttagtcatcataaaactcgtttgctgagtatgactgactcacctggtatttcataaagtgctacttatgagacccacaagaaagattaagcctcatgtgaacaggctgatgggaaatccacacagaaaatattttgataagttctaaagcagcaccacatgctttagaaggtcatgccaaaggcagtccaatggggtcatcccagtgcatcctaaggaccaccagctccagcaggagaattaggtaaaagggcaaggagaacagcacacagggtcacagagaccctggctccaccaccagctcgctctgtaaccctgtgggagtgagttgagggagtgcgttgcttctccctctgagcctcagttgcctcatttgtcaaacaagcattcacttctcagggctgatgtgaactttaactgaggtgacacatgtctaactggttcaggggtacgtctcaacttgttgaggtgtaactacgaaaccactttatttttacaataattgctaccaaatggtctctgttgaaatttcctttttccctctggggaatgatcagaataacagagtagtggtagtagaggcaggagcagaggtagcggcaagctcccaggtggccccgcctctgtgccaggcacttgcctaagctcttggcatatattactcaccaaatcttcacaatgagcttctgaggtagggaccaatagttatctccattttacagaaatagagaaaaaagaacttaaatgagttgcccaaagtcacggagctattaaagaatgggcttcctcaaccagcctctcaacaattccatagcatgcctgactgactctttggttaccaaagctgtctatttcaggtcttaaaacccaaatctcctccaattagaatgtcagtctcaaccagtgaagcacaacgagacccagtctcatggtcatgatgtcgaacaaacgaagacagacaccaaaaagcatgcacggcatgattccatttatgtgaagttcaaaaacaggcaaaagcaatccagggtgttagcaggatagtggtcacccttggcaaagggtagtgactaggagggttactaggtagctttctgaggggctgggagagttctgtatcttgatctgggtgcaggttatgtgagcatgtttagtctggggaaattcactgagccgtgcacttatgatatatctgtgtgcatgtacacacatatacttttctgtatgtgttttatagttcaatataaatttccttggaaaaaacttcattctcagatctgattcaaagttcttttagatcccctggccccatgtcacccagttcaagccagactcatgattctagtggcttggagctgggacaatgggtagggggagcaggagaagcaagacgtgctctctttccccttctccttgacgcccacggtagaatgggcataaggatgggctgccattctgctgaaatggctccacagcgagccgtgaaggaaggtggctgaccccaactgctgaatgacctttgaacttaggccaagagactcagagcacccctaacatcatcctgttgcacatgtaaagtgcctagcacaaagcaggtgtgtaatggggggggaggtgctagatggagatgcaatatttttgatatcttgaggactaaaagtcgggatgatctgctctttcaaatatgccagaaatttttggattcataatcagttgaataattgatttctatttgaagccttttagttagacaaaaggaaaagtgataagtctgccatcttcatctgagttcctccagaagccaactctgagacaaggatttaaatgcaagtaatttattcctgaggagatccttggaggcagcaggtgaggagtggggaagtgaccacgaagtttctgatttaggacagtggtgaaaagttgatgcaggtggcttctaaaagatcttgacttccaaggcaactagggctctggggaaggaatatggctgaacttcagacccatagggctacaggaagatagagacagaagacaaagaccatgtaccagttagcatgctctcaactgcaagtagcaagccaatccaaagtggcttaaacagtaaaaatgctcctgatgtcttcaaataatgtcttcaaataatgtctgggaagggacatgaatgagcatgtgggccagtggggctcaaacccacccatgtaagggccatgcctccacattgccatacctgagaagcaaggagctggggtatttatctctttcgcactttgggaggctgagcgggcgaatcacctgaggtcaggagttcaagaccagcctggccaacatggtgaaccctgtctctactaaaaatacaaaaagttagctgggcgtagtggcacatgcctgtaatcccagctacttgggaggctgaggcaggagaatcacttgatcccaggaaacagagcttgcaaagagccaagattgtgccactccagcctgggcaacagagtgagactctgtcaccaaaaaaaaaaaaaaaaaaaaaattgataaaaagagaaagagagagacagagacctcagaaagacagagtgaaagggaggggttagaataaagggaggatgaagatcgagatgaagtgacagagagacctaagaacttgtgaaaatgtgcttaccaaaatgtgagcagtggccaggcgcggtggctcacgcctgtcatcccagcactttgggaggccgaggtgggcagatcacaaggtcaggagatcgagaccgtcctggctaacacggcgaaaccccgtctctactaaaaatacaaaaaaaaaattagccgggcatggtggcgggcgcctgtagtcccagctactcggtaggctgaggcaggagaatggcgtgaacccgtgaggcagagcttgcagtgagccgagatcgcaccactgcactccagcctgagggacagagtgagactccgtctcaaacaaaaacaaaacaaaacaaaaaacacacacacaacacgtgagcagtgaccagcacaggtagtaagagttaaaagtaagttgtgggccaggcgcagtggctcacgcctgtaatcccagcactttgcgaggccgagacaggcagatcatctgaggtcgggatttcgagaccagcctgaccaacatggagaaaccctgtctctactaaaaatacaaaattatccaggcatggtggtgcgtgcctgtaatcccagctgctagggaggctgaggcaggagaattgcttgaacctgggaggcagaggttgcggtgagccaagatcgctccattgcactccagcctgggtagcaagagtgaaactccgtttaaaaaaaaaaaaaaaaagtaagttgtgtctcttttatatgcacttttcaagttttcttcattaaatgagtattccttttgtgataagaaaaagaaataagaacaacaaaaatgtcctacctccaatgctagaacttccagctctgcgtgtgaaaacacccactttaaattgcttctctctttagttcaaccatgtttcttgaaatggtttgaatacaggcagagtttccttctctccctccttccttctttttccttttttttaaaggagaccaaagtcagagttgcctcagtgctgacccaacattgaggctgaaagtgggtacaataagggtaatttaagaaggcagggattaacagctgctttggaaatgacaattgggttaacctcttcttcattctcactctctctctctctctctctgcaagaaccatcttgccctagaggaatgcaggaaggcagtggggagggaaaatgactctgtttagggaggtgataaaatgggatgtgatgattaattcttcatatatttatttgacaagcattcagggagcacctcttctcgcccaggtcctgggctaggccctggggacatagcaagatgaatactacaggatccacgactgtgagggctgagagagacacacgtgcagattgctaagaccaatatgagaggatcattccatacccaaacacagagttgcatgaaggccgaggttctgctttcaccccaccagataccaatttcgctcctgaaatgaagaagtaaggagtgaccagagagaatcttatttagcaggcagtgatgataagttaatacaggtagtttccaaaagatcttgacttccaaacaactggtgctctggggaaggaatgtgtctaaacatgagacccatagggctaaaggaaggtagagacagaagacaaagaccctgtatcagttagcatgctctcagctgcaggtaacaaaaaaaccaacccaaagtggcttaagtagtaaaaatgtttatgatgtcttcaaataagtccagagctaggcagtcccagggacaattcgataactcagtgatgtcaaggacctaagtgctttttatatttttgctcctctatcttagcctggttttaaaaaaaaataattcctcccatatgtctctcttttttttttttttttttttttttttgagacggagcatcgctctgtccccccaggctggagtgcagtggtgcagtcacggctcactgcaagctctgcctcccaggttcatgccattctcctgcctcagcctcccgagtatctgggactacaggtgcccgccaccacgcccagctaattttttctatttttagtagagacagggtttcaccatgttggccaggctagtcttgaactcctgacctcaagtgatccgcccgcctcggcctcccaaaatgctaggattacaggcgtaagccaccatgcctggccccatatgtctcctttacaagaagggaaaatctttcccagaagctcttgggcagattttgcaatactgccattggccaggattgagtcccatacccatgccctgatgcaaaggaggctttgaaggggcctcccagttttttcttcttggcactgtcagccaagaagaagggggaagagaaagatgaatagataggcaaccaacagtgtctgcctcagaagggaattaacattcactgggccctgtttataaccccagccatcccccagatttccagcttcctctttaatatctaacatcggaaccccatgaccctaacaagacagaactttcatcaggttctttctgcaggatattactcagagtctctgggggatgttctcatgttccctggaccatgcttgtgattgcttggcaaccacagtgagccctttctcccagggcatctactgcccttgtctgccacctcctaactgtctgcaccaggatggtgctcctgtcactaacaccatctcaacttgaaagtagtacccagccctcttccttaacagcccccaaaacatggctggattgattagaatataggtttaattactgtaactgagaccctcattaacagcggtttaaacaaagcagaagtttattactttttttttttttttttgagactgggtttcgctgtgtcacccaggctagagtgcagtggtgtgatctcggctcactgcaacctcctgggctcaagtgtttctcctgcctcagcctcccaagtaattgggactacagggatttgccacaatacctggctaatttttgtagttttagtagagacggggtttcaccatgttggtcaggctggtctcgaactcctgacctcatgatctgcccacttcggcctcccaaagtgctgggattacaggcgtgagccaccatgcccagcccagaaatttatttctaaccagtcagaatgatacctacaagcaatcaggatgactgtagctgtgcatatcagctgaatatcagcccttttatgtcttgttcatgtaacagtgtgtgtgatcagtctggggctaatggggctggcccatggggtcagagtctcaggctttttctatcttgttttcttccatcccttccatgttgctcttgtccacacagttcaagttggtgccaccatgtcacattccaggcagtactatggaagaaaaggtgaaagaaagaccccaacccagccgggcttggtggctcacacctgtaatcccagcactttaggaggccaaggtgggcagatcacaagggcaagagatcaagaccatcctggccaacatggtgaaaccccatctctattaaaaatacaaaaattagctgggtgtggtggcacgcgcctgtagtcccagctactcaggaggctgaggcaggagaattgctcgagcctgggaggcggaggttgcagtgagctgagatggcatcgctgcactccagccaggcgacagagcgagactccatctcaaaaaaaaaaaaaaaaaaaaagaaagaccctgaccccaccccacactgttcctgaaccaagcctttaaaggcatgatttagaaatggtgcacgtcacttccactcaggtcctattggtcagcatgcagtcatatggcacatctagttgcaagggaagttgggaaatgtagtctttagccaggcaggcatgtgcccagttacaatcctgtttctatgaaagcagagaactgacactggggacaattagtatctgacccagcagctaagatgagcccatagcagttaacaaaattttactgaagccttggggataacaggtgagaattacaatgcagaaaagggaaatgcaaaatgaaattgtaaataaatcatgtttggaggccatatagctgcttcatgctttccttcctgctggtcttcaccctcctttctctctagcatgctgtcatgctgtgagaaccagcctacctcccgtggatgatggctgcctaacttcttctccctagaatttaggaccccctctttctcctctttgccccaggtaaagcaaaaggccctccccttcccacagtgagtctggcttccttgcctaccccaggatatgggcagtgggaatatccatgtcctcctgaagaaagtacaattccccatgtggttccccttgcagctcacttccctgtggcctggatgaggccatcacaagagttgtaagtgcgatcccctaagcccgggtccctccactttcagttattccaaatcagagtcctctccaagggcttcccaccagcacaaggggaaggaaagttcaggtcagcgcctcttctctgcacagtcaagtctcaaacagaagaccagtttcatcttcaaatacagaaactgctggagcaaatacttggtcaaaaaggtacacatctttcccaaggacttcaggaacccttctagctaaatcaaagcttagaaattcattcctcttttctaaaaggctatggtcctagtacagatccacccaacttacatgcattatcacaatgctggtgtgcaacagtgggcaagtcatgtatcactccaagcctcagtttcctcatctgtgaaatgaggttaatgacagtttctcttacagggttgttgggaagatgtagagagatgataaaggtaaagtgctagcttagtgcagagcctagtctttcgtcaaagcccaatacatgtagctaacataactagtattattaaacaataagaaacaactcaacatggggaatctgcatctggataatatcactgtcttaggattctccccaagagcagtgatttctcccagaataatggaagaacattctcatcttcaaagacaaaaatggctccaaatccccttcaaaaacttgaaaaactagacttcacctccagaactggttacataagctcaatgcagaatgaatatgcggggctccttgttcaaacattattgcgagtttcggccaggcacagtcgctcatgcctgtaatccctgcactttcagaggccgaggcaggtggatctcctgaggtcaggagtttgagacaagcctggccaacatggtgaaacctcatctctactaaaaacaccaaaattagccgggcgtggtggtgggtgcctgtaatcccagccactcgggaggctgaggcaggagaatctcttgaaactgggaggcagaggttgcagtgagccaagattgcaccactgcattccagcctgggcaacggagcaagactccatctcaaaaaaaaaaaaattattaagaatttcaaggctgggtgcggtggctcacacctgtaatcctagcaatttgggaggccgaggcgggcagatcacttgagatcaggagttcaaaaccagcctggccaacatggtgaaaccccgtctctactaaaaatacaaaaaaaaaaaattagccgggcatggtggcaggtgcctgtaatcccagctactcgagaggctgaggcaggagaattgctttaacccaagaggcagaggttgcagagagccaaggtcacgccactgcactccagcctggacaacagagcgagactcagtctcaaaaacaaacaaaaacaaagaaacaaacaaacaaacaaaagaatttcaagacaaagacagcagagcaaacaagtgcaggccccttctgagctcgggactctgcaatcacacaggttgcacacacacccatgaaaccagccaagttcacctacagcagcagaacaaaaaatagggttgtaaaattgcaggttgcaatatatattatgaaaaacttctgaagacagatggtagcttgcttttttccactcagcaacttacacaactgtagaacaacagcaaaatttttgagtccttgctgtgaactagagaccaggctgagtgctttacacacatactctcatttaatcatcacatccctgcattctgtaaaagatggaaaaccaaggattggagagggtaaggaacttgcccaagggcacatgagcccaattcagcctaattccagaacccacacccagaaccaccatgtgtacagtgaaagtgcccccgcaagcctcagccctgcaaactagagtgtggaggatgttgtaggggcctctggaaaccctccccagactcctcctttgctgaaagcatggagctgggaccggtttccatctttggatccaacttccctccttgaactttcccgcacatctctgaccctcctttctcagaacacatgtgattcccctagttccccctgaatgcctcctcctcccccaccggggaagttgctcttaccagacaggcagcgtgggattatgtttacgcatttatttttgtttctttttaatgacttgctgtaaagcttaaaatgtcttccgggtggtagagaggcaggggagtcgcccattaaaaatgaagcccagtaaaaatgaagcccagtagagacgtgagtgggagattctgggctgttaaccttcccgtgagttctgaaatagtgcagaactcatatatttaatatagtttcagaactagaagcagcaaatagagctgaactgggttcaaatcctgactccaccatttctcatctgtgtgactgtgggcaagttgcttaacctctctgtgccacggttcaaatggagatcacaatagtacaggctccagagtggtggtgttaatgaatgattatcgttattattatcctcattgttattactattgtttttagagctcatgggagtccttggagagactgtatagcttcatggctgagaatatagatgctgaaatcaggctgcatctgggattaaatcagggatttaaatcccacttgactacctactggctgtatgaccttggttaaataactggcctctctgagcctcagtttcctcaattgacaaattctcccctgggcagagggattggattagagatggcatgtgagcttcagttggatcaatgagactcaaggccaggactcagggtccaccagggaaaagaagctcttcccactggagctgctgagctgataggctgtgagcctggggctgctggggctctagaggacagcctgctcgagagtgaagctagcacaggggaagaaacataaaagagctggggagagagagagtcacaatgacgtttgaggccctggatctggcggtgcctgaagcaaggaagcctcctttggacttcccaatttcatgagccagtaaattccccgttttgcgaaagccacttttcagttgggtttttctcactggaaagtatccaggctgacaccaggatttccatttagcaacttgacccaggcctgcaagctagtgagtagcagcctcaggggttagaagctcctagctctgtaccacggtgctctgtcatccagcatgcaagccagcattctgtactgggtgttcattgctttcacctctttagcctctccgagcagctattttctcatctctcaaatgtggataaacagcaggcttgcagggctgttgggaaacacaaaattcaaagtaatgcttttaggccaggcatggtggctcacgcctataatcccagcactttgggaggctgaggcgggcagatcacttgaggtcaggagtttgagaccagcctggccaacatggtgaaactccatctttactaaaaatacaaaataaattagccaagcgtggtggcaagtgcctgtaatcccagctccttgggaggctgaggtaggagaatcacttgaacgtgggaggcagaggttgcagtgagccgagattgtaccagtgcactccagcctggggcaacaaagtgagaccctgtctcaaaaaaaaaaaaaaaggtaacactattagttagcatggtttatggctgaaggttggagttctgtgcacccagtttctagtgccttgggccttggcttttccccattacttattccattgcagggatgtctctggctgtccctaagtcagccaaccagtcaaagtgcccaaactctcttaggcgagcatgggtgaatcttgtggggggaagagccatcttccttcctggctatgtgtacccagtggtgagtggaggaagctagatgaccttgaggattcttgaactctgagtctatgatgtacaaagaagccctgttatgttcatttccagaaccttctaaaactgatatgctcttctgggaatgatctgtattgcagggaaacagcaatgaaccaaatcgacttagtctctttctttaagaagtttacatttactggcagatacagatgataaacacataaaaatatacaacatcatatcacatggtaacactagggaaaaaataagtcattaaatgcctgctaagtgccaagaagaaaaaggaatagagtgatagagcactgtttattagaagtggtcagaagggggctctctgaggaagtgacatgtcattagagactcagtagggctcattcaggatcacaagctcttaaaactgtgctatctcccaggaagaagatcaggaccaatttttccaggaaacttgctgacctcactaagtcaggagtcagtgatctgttggaggcttggtaaacagccatccttctccactgacgactcttaggacatttaaaaaagtttaatgggtcattgatttgtagtgctgatttcctccattagctaaatccacgaaggaaaggctggagaagccgcgtgagaccattcctcaggcatgcctgccaggaaaaggttttagccatcatgtcacatgatcatttgtctatttctaaccagtcatcactaaagattcccaatcaccaccatcacatctctggaggatcccagggcatggctgcttctaggccaggccttggcagggaagtgccagagctttgcagatcaacaccaagcctcagagagtcggagtagaccttaagttcctcctctcaaccaaatatcaaggaaacagacaagaagtcgaggtccctgccctcctagaacatgacattgaggggcaggagaaagaaacaagccagcaaataaataagacacagatgagtgctaggagccaccagaagctagaacaggaaagggaggatcctcccctagagagtgactggggactattttagggaaggtggtcaggggagacctgtttggggaggtaacgtttgacctgagacctgaaagctgagaagatctgcaagaagcgtgatccaggcagaaggaacagctggtgcaaagatgctgggttgggagccagccccgtatatttggagatagacctgagactgcagggaagtaagcgaggggacacagtgacgggccaggtcacgtgggccttgtgggccagggttagacatgatttgggttttcttctaagtaggatgggaaactgttggaggattttgcataggagggtttcatgacccaaatattaaaagctatgtacacaatgaatggaagggcaaattagctggtacctgaaattaggggtttcgttcaggatcaatatttgtggcaaggtttcactctctgccactgtagtagattgagtggaggcctccaaaaagatatgtccaagtccccatacctgtaaatgtgacctatttggaaaaagggtctttgcacatgtaataaatttaagaatcttgagatgggattgccaaatcgttctggataggatgagccctgaatccaaagagaggcatccttgtaggaacagggcagagggaaatggggcaggcagaacaggagatacagagaagaaagtctgccaagacagaggcagggatcagagtgaggcagccacaagccaagtaatgactggagctaccagaagctggagaatgcaaaggaggaccctcccctggagccttcagagggagcacggcactgtcaacaccttgattttggactttgggcctcaagaactgtgagagaataaatttctgttacttgaagccaccaaatttgtggtaatttgttacagcagccactggaaacaagtacagcctctaaacagcccaaacttggaccctgcttgaggctgcctccaactcccctctcccccaccaagaccctgtgtatagcttcggccccattcaaaggctactccaggctgggtgcagtggctcatacctgtaatcccagcacttcgggaggccgaggcgcgcggatcacctgaggtcaggagttcgagatcagcctggccaacatggcaaaaccccatctctactaaaagtacaaaaatcagctgggcgtggtggcgcacacctgtaacctcagctactaagaaggctgaggcaggagaatcgcttgaatccgggaggtggaagttgcagtgagccaagatcacgccattgcactccagcatgggtgacagaacaagactctaactcaaacaaaacaaaacaaaacaaaacaaaacaaaacaaaacaaaacaggctactccagtcactgggcagcaccccctgcaggcgtgagggccacttgggcttgggatgggcatttatttacttacttagcttgacatacagggacaggaatgaaccagccctgtttttgttccaggatgctctcaggattgtgagttccagacaaaccagaacccaaaaagtataagggtttaagggcgggaggagcacaggagtctggacagtcacttaaaggaactaagacttcaattaggtagcttccaagtgtggcagctcccacagttttcactggaatgggcatttttgttaatttttcccctatggaatgctcactttctaaagacactgctgatcaagctaattgcatgtattcaataacatttcatttatctcctttatttgctattatttaaagatatgtagtaatgacagttaatatttattgagccactcagtatactaagagcatgatatgtactcatccaaccttcacatcagccctatgaggtgggcacttttattatctctgttttacaaaggagagcagagactaatgaaaatttgcccaagtttgcaccactagtatttattcagctggaacctggacccacgaagcctggctccaaagcaggctctggaaaccaggctagaatgcaggtttccataccaatgtgcaatgctactctggacaagtaattttgtctctctgtgcttcagtttcctcatccattttttttttttaagacagagtcttgctctgtcacccaggcccgagtgcagtggtgtgatcttggctcactgcaacctctgcctcccaggttcaagcaattctcctgtctcagcctcccgagtagctgggtctacaatcacacgccaccatggctggctaatttttttgtatttttagtagagatggggtttcaccatattgatcaggctggtgtcgaactcctgacctcaggcgatcacccgccttagcctcccaaagtgctgcgattacaggcatgagtcaccgcacccggtccccccctcatctaattttttatttttattttaatttaatttattgtatttatttatttattttttgagatggcatctttctcccgtcgcacaggctggagtgcagtggttcaatctcggctcactgcaacctccacttcccaggttcaagccattctccttcctcagcctcccaattagctgggattacaggtgtgcaccaccacacccatctattttctgtgtttttagtagagacaggctttcaccatgttggccaggctggtcttgaactcctgaccttaggtgatccacctgcctcagcctcccaaagtgctaggattacaggtgtgagccaccaggcctggcctatttttatttatttattttttttgagacagtgtctcactctatcgtccaggctggagtgcagtgacatgatcatggctcactgcagcctcaatctcccaggctcaagtgattctcccatctcagcctcctgagtacctgggactacaggtgcacgccaccacagccggctaatttttttttttttttttgagacaggatcttgctctgttgcccaggctggagtgcagtggtgcaatctcagctcactgcagcctctgcctcccaggttgaagtgattcttgtgcctcagcctgccgagtagctgggattacaggcatgcaccaccacaccctgctaatttttgtatttttagtagagttgaggtttcaccatgcttgtcaggctggtctcgaattcctgacctcaagtgatgcacccaccacggcctcccaaagtggtgggattacaggcgtgagccaccacagccagtcagttttctcgtttataaaatgggaataatagcacctgtattgaagggttgttgtggagattgaatgggaatgtgtacttagaattccaggcatagtgcctgccacaagcactcaaggaatgagctggagttcagctgataataccaggcagtgtctctgggcaacacggaatgaagacaattctctcttccaggttttcaaacctcctggaattcacaacgtccacatgacatgccaggcccagagggggatggtttaaactggagcctgcaggaaggcaacctgaccaacctgctcatgggtgctttaaggatcataggtacgagaatcagctggagttgttggtgaaaatgcagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaatttttttttttttttttttttttagcagaaaccgagtttcaccatgttggtcaggctggtctcggactcttgacctcaggtgatccacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccaaagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtccccccaccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataataccttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtactgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgatttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgattttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcagttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcatagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtgttaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaatagatttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgatttttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgcgtctgaaaccaaatcattgtttttgtttttaacttttttcttaatatattatccttagttcagccctgaagattattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgccttgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctctttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctcatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacccaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccgagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaccaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattatgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcctgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggtggcttcttccctttgtgctgctgaacatagggaaagtgaggttcacagtccaccatccaccagccgccgtctgtgagctccaccagcactcgcagcaagtcagtcgggctgagagtgtggttgtagaaaccctggctttgtgccttcccaccttccccagctcaccaaggtgacacctggctgctgctgaaatggcctgagcagtcttgcattagcagggccagccacctgccagcctgctgcatccccagtgcctcttgacgcagaagtgccgagcagctgaccggcagcgaggcctggagttctacacacttgccttggagccttttatttagggcctcaacttgcctggccttggcccttttgtaggtggccacctagtttggctcagctctgcatctcggggaaggtcacacagaccctcagccagaagttgagcgctctgttgaggccgtgcagcccctggaatgctgtacctttgccttgcttttttctgcctctgtacaaaagaccagcccatgccctggggctgggtcaatggccggagtctcaggtagagctctgggcagctcacactcctggaggagtgcacagcaccattacccagagtgcaggctatgtccaggctgggcagcagcaaaaaaaacgatgtgagatttgtgctcatcagccaggattttttaaaatattgtgatttcaacatctgcctcctggcaaaagacttctctttgttctgagcagagcttgtccatcttctcaaaagctaaccgtcctttttcacctgaaatagcaaagggacctgtcagcgggttggatcctgccttggcacttccaactctcctgggccagggtggccctagtgcttagtgactgtgggtctcagtggtctctgcaaagcggcaggggagggagtatgtgcgggagcccccacctggtgactcacatggcctgggggccttgtctttacctctaggatgttccgctgaatgggaaccctgccttgcctctggcttctatcccaaaggtctaagaagacagcgaacactccctgccaccccagccatggaggaggcctgccttggcaggatgctacaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgccctgttcgagattaggagaaaaagaaccctttagggggccttctcaacagcaggtagagtccacttagtggccctgcagggccagtcctagcatggtctctggggcctcagccccttccttttctccaggcttccaggttttttaggtggcctcaggttcatgagaggcacctctggactctggaagcgtctcgcctcttcagcccttacacccgctagggagccaggctgttagcagaactcgtcatcctggatgcctgctgaaaggctagaattgaaaaggagacctgctgctttctggaccttcctgcctccctcacgctctccttgccctactctccaggacagcctgtgccagtacttcgcccaactcaggcacatgccccctggctgctcctgcaggccaaggaccggcatgcgctgcagcgccctctactgggcacctggccctcgctggttttctgatcctaaccagcttctcctcttagaatttcctgctgatccatcccagaatgaatgggagttcaatctgtactgaattatctttcatctagcaattgtgcaattccaaatgcaggtgaggttgagggaaagcgggcatcccctcacatccatgggatctatgtgtgggttgtatcaagagtctcaaaaatgctcatattctccggtcctagaattgggtctagcctaaggaaataattcagaactccatgtttttttaaagctttatgcacaaacatgatcataagacatgatttatgataaaaattggatgaagtaaactttcctatgaaagcagctgagtaggttaaattaaggtatacacttgatagccccttcataaagaattctcaagtgaaaaaaaaaaaaaaaaaaagaaaaaaaacaccacaaataaagaattctaggccgggcgcggtggctcatgcctgtaatcccagcactttgggaggccgaggcgggcagatcacgaggtcaggagatcgagaccatcctggctaacacaggtaaaaccccatctctactaaaaatacaaaaaaattagccgggcgtggtggtgggcgcctgtagtcccagttgctggggaggctgaggcaggagaatggtgtgaacccagaaggcagagcttgcagtgagccgagatcgcgccactgcactccagcctgggtgacagaacaagactccatctcaagaaaaaaaaaaaaaaaaaaaaaaaaaaaaagctaaagtgctgccagtctaacacaaaatgttcttattttgttgactgtttttaaactatgtttggatcaacaattttaaatgctcacacacacccacaaacttttaaaagaagcataccagaatgtcaaccattgtttctgctacattctaggatgatggataactttcttttctatctctgtattttgtaacttttttttttttttttttaagatggagtcttgctctgtcacccaggctgcagtgcagtggcacgatctcggctcactgcaacctccacctcccgggttcaagtcccgagtagctgggactacaggcatgtgccaccacgcctagctaattttgtgtgtgtgtattattagtagagatggagtttcgccatgttggccaggctggtttcaaactcctgacctcaggtgatctgcctgccttggcctcccaaagtgctgagattacaggcgtgagccatcacgcccagccccagtggaatcattttgaagttaactaaccttaaccctaaccacaagcaggcttttctatcagccactaatggggaaacgtcaggctcaccttgaggtgtttgagcgctaggcatgcggcctgctggagccttgcgtcgttctctgccagggcgttggtgtagaacagcaaagcctggggagagtaaggaggctgtgaatggaggggtaagcagaagtggagtccatggttccgggtccatcagccaccaggtgccgacagtaaggcacgctgtgcccatctttctctaaacaacgttcaggacacgatcggtccatctttgggccctgtgtacacagtcacaagatctatactgtggtgtttaatttatccctaaaaacagatgccagggctaatacaatgaagaaagctatttttgtctaataatattccggaagtgcattctgaaactgctgtctataaaatgctgaatcagagaaatcagatgcccagctcagaacaacagaagaactgatcatcccatgtgcgttgccctcttcagctgaaaacgggcaaggctgctgccttgggccagagggaaacctgcctattcccctcagccctcctgtccaatcccagcggtgaccctgccctcttcggtctcacgaccatggccacatcagttcatgtctttgggcctaacttgactcagctgaaaacaaagctggcacttgcttcatgtgttattgtagggtttgtcagaaagcacacagggttatgcccggcccgcagtggagtccagcgtctgcggctgcaaagggaaacccaggagtgggtttgccctcactcagtcgagtggctgcaccttcaactgcacgggtggggcgatggaggggcccaggtgtagagttggctccagggacctgggcccagagccaaaagagaatggccgcctttccatctgcaggtggctctccaaagtgtctgctgctttgggaagacagactgggagtaggatcgggtcctcccgctcctcctacacagggctctggtgaaggctgtgaggccacatcggtgtggaaatgtcacactgcccactgcctctaaccccagggtcccaggtcatggcagcctactccttcctcagcaccctcatctgaggccaagcaatctgtcactgggttggcccccacctcagtgtttcctactctctaaagtctgtcacatgaagatgaaggccctttttttttttttttttgagacagagtctcacttcgttgcccagcctggggtgcagtagcacaatctcggctccctgcagcctctgcttcccatggaggccttgtttatatacccccatacccaaaaaacaaaatacacctgacttcagtggatccttgaagccaactactagttttcaggaactacagaagacagagaaatacattaaactaccgttaaacttcctgcaagcagcaaagtctagatagtctaggtcaacctgggatcgatcaaattaattgcaagcagagaaagaaacggggaaaaaaacctttagattgattggaagccatcagccaatcacaatgtgtgtccttatgtagatactattttaacaaaaaataaaacaggatgcttgaggcttggaaatttgaacataagatatatgatataaaggaattgatagttaattttttagataagataatggtgttagagttgtgatttttgaaagaattcttaaccttttgacacatatagttaactatttaaggtcaaataggatgcctcaggttgcttcaaagtgatacaggggagtggaggggaaaggggcaggattggccatgggttgatggtggttgggcttgggttatgggtgcaggtggattcattatattgctctgtctacttttgcaagttcaaaagtctccaaataaagagttaaaaacaaccacaaagtaggcggatgggctccaagaagggctattggcaatggaactggagatttcctctctagtctggagctgagaccatcagtgtagactatgcccttgatgtcacccttcctgaacccctcagggtgtggcgccttaaacgtacagtagttacaggcaaagagtgaaaaagcagagaggtccactctcttggttttcaaatggactgaacacagtgacccattaccaggtagccatgaatattaattgaaagtaaataaggatgactatcaaaacactaagaaaggctgggcgcagtggctcacgcctgtaatcccagcactttgggaagccaaggcaggcggatcgcagggtcaggagtttgagaccagcctggccaacatggtgaaaccctgtatctactaaaattacaaaaattagctgggtatggtggtgggcgcctgtaatcccagctactcaggaggctgaggcaggagaattgcttgaacccaggaggtggaggttgcaagatcgtggcactggactccagcctgggcaacagagcagaactctgtctaaacagacagacaaaaaacgcactaagaaaaacattcagcgtgcaagtgacatctcagaggcctaacagatgtgttgctttggaagcagcaaggtgcattcatgtgtgttagatcgtagcccaggtccctccatcaaaatagctcacagctactgcagcccctggcactcacttctttgtacttttccatgagaacaccagcttacctatgcccacacatctgtggccagggtctgccacctgccctggacaacgtaccttttcccggaagcttctgttcctgactgcaccagccaggcgagcgctggccgccctgcacaccctcggagtgccgtccagctggagcagcgcccaggctcttaaggtctggggcagaggctggagctggcccagccgcttcccctgcagcttccggaccaccttggcctgtcccgcacagtgaagctcctcgatgagtgtcactagaagacaggaaagaggtgggcccaggtcccctgaatgggagtttggcaggacagctgcaagtttgcttggctgctgccagtagccacagaggaacaaatcccagacccaccgggatgatcaccaaggcccagcctggactaatttcacagggagctcctggaatctccaggaaggccttttaacaaggggtcaaatatgctccataaattaataaaaccacagcccacacttccagggactctggccagccaagatcaccctcctacccagctctgacctctgttccgtgctttttaaagctgacttcccttggagctaatatcagcccccatcggctgaacgcagaatctcattaaatcggggttcccaaaagaacagttggcggggatggatgtagtggttctgaattataacctgagaaactgcatgtgacagggctccgtggatattcctctgctatgacagccacccaccccagtcttaccttccttggtgagctgggtgaagtgcttctccaggtcagagacgctctgcctctgcaggtagctgtgaaactggaaccaggtaatgatctgttcttctgggagcccagctccggggagcagcccaccacagctgaccacctgctccaggagcctgcggcacgctggccaaaggggagagtacatcaggagaaactgagacctcgaccctccacgcttctcagctgggagtagcctggtcagctaaaaggctttctgggccgggcgcagtggctcgcacctgtaaccccagcactttgggaggccaaggtgggcagatcacctgaggtcaggagttcgagaccagcctgaccaacatggtgaaaccccatctctactaaaaatacaaaattagctgggtgtggtggtgcctgcctgtttcccagcaactctggaggctgaggcaggagaatcgcttgaacccgggaggtggaggttgtagtgagccaagattgcgccactgcattccagtctgggcaaccatgagtgaaaccccatctcaaaaaaaaaaagggtttctgatggcacgagggcaggtgtccctcactgcattccctgtgctgtaggggaggagtgtgcccagctagagtcaggactgtgactccaactcaccctgagtcagaccgtgttgggttcatccccatgccctgggccccacaccacacctggatcaaaatcccggaggcagggcctgggaatatgcatgtcaacaagcagtccaggtggtgcttggaacatgactgtcacctttcacttgctccacagagaaaggcaaattctggggaagaacgcagtccagccagcatttctagataccctcgtgggcccctgcctgcctcccttcccataaggttcattctttacccgtcaggctctggtgggaggcatggaatctgtccccagaaaaatgctctggcggccgggcgcagtggctcatgcctgtaatcccagcactttgggaggccgaggcgggcgaatcacaaggtcaggagttcgagaccagcctggccaatatggcgaaaccccgtctctactaaaaatacaaaaaaagaaaattagccaagcgtggtggtgcacacctgtaatcccagctactcgggaggctgaggcagaagaatcgcttgaacccgggaggtagaggttgcagtgagccatgattgtgccacagcactatagcctgggcgacagagtgagactccatctcaaaaaaaaaaaaaaaaaaaaatgcaccggcccaccaagtttgcacgcagcttcagggctccacagactgctcagaaggccccacgtggaggccccttctcgcccggtgaaagggcggtgactcgcactgaagctgagaaagctcctccgtccgatggcatgaagacacagaggtgaagacagggctgaaatgaggccagctgtggccaccctgaaggccctggagactcaatacagcctttctgtgggaggggacgacaggacagaagggaacccacctatttccagctgtcctgggtacttccctctgactctgtgctggaaggttttcttgagctggttcagcagcgtcgtggcagggcaggacaggaccctgccaggccctgtgcaccctctccacagcttcaggcaccccttcgtccgcgaggcctgtgggatgactgaaagccccagttcagaaacctgaatggtgactcggggagagcacatgacaaggacccgaaaggtttccctccactaggacctgagggggtagggaggaggggacggtgtggcttgatgcgaggtcccttccctgcattcccatgtgacacgtgagcaactttggctctaagcatcttaccagggccaccacctgcagtccccacaacaacctgggaggggctgctgtcaccagcctctccttacagacaaggaacctggccttctgaggggaggtcccacggggcagaggcacagctgggatcacagctactgtttgacggcacattctgcaccttgaatgtggcctggggttacctcactgaaccccgtgcagtgccctcctcctatgcagatagggaagcagaggctcagagatgtgaatcatttgcctagagtcacacagctgactgaagagtgtgctgcaactccaggacttgtctcccttacctccccacaaagagtgtgtatctctgagcccagcccagccacagcctccactctgggccccgattaactctggctattaggaaggcagaagaggctccccgagctttgatcccgtccccgtgccgctcacataggcagcccctgggtggcaggcagctacttactctcttcaatggatgttgccttgccgaccttctcaaagtcaaggacagaaagtgtctccagaacgtgcttttgctgtgccacttcttccaggaggcattcctggaccagccttgataaattaggggaggccagtttctgggaagcagcccagatgctccagattagcatggaacatgcccaccgaggtcagctgttacggctgtggctcccacctgcttgtgcccatctcttctgtcccgggggcagctccctgactgtcatttggggattcccctttcaccaaggtggctgagctaatgggatgcaggctgggctgccagggaccacctttgcccccagaaggaggaccaacctgcctgaaagtgaagccaacccacattgcaaagcagaactgagagagacctagtcctgatagcatttgaacccgtgcatccagccgagcctgaagcctacctctgaggctttcagtaccatgagccgataaattttcctgttggctgagccagtttgcattagggttctggcacctataaatgagagtcaccaccaaagcctttggtttagggcttggcctgtgtaagagccacacgagtattcacccagaccctggtctgcctctcttccactggggaatagcttcagtctcacgggcttccaggatgcaggtctgtcaccccttcatgcttcccaccaccttcaagatgagcctttgcaaagaggactccaaacccctgtctgcccctccctgacaagtcccctagcccagccacctgcagcagagctttgcagacttggaggtgtaccatcagcagcacgtccagctctggggcaccggctgtgagttccctggatgacgctttcagtgatgacggtgggggcaggggccggtcctttctgagttgaattgagaactgggtgaccattccagttagcagttcagctccctctgagggtgggggaaccctcccttcccagcgagccccaggtcaggaggcccactccaggtcccaggaagttcaactgaagaggaaggggaaaggaacaaagggtggcagcaactcgaaacagagctgggaggtgtggccaagggcctggggaaggcagggcgggcagtcgtcttccaggatgtctcgtggaggtagaagagaattccaactcatcccagctctgtgacgctggacaagtctgcctccccaaggctcaggtgactcatctatcaagggaggcaggagccccacactcaaggccgtgaggggtgcatgaaatacggtgggcaagagcgcctcacaccaagtccactctgtggtagaggctagacctgctgcccgacccactcagccactcaggaagggtggaagcaagtgtggcacgaaacaccgcactcgtccgtgggattgtgagaggcgaggagaaggaattgagcctctgctcttccatgtggtgagatgcggatgcagaagccctcgggggctggggcaggtgaggctgcgtagcctcgagggaagctgtcatgagaggtgtgggccctgtggtgggacagagggaacagcactggatactgctgcaccttggttaggggctaagagctttttttttctttttctttttctttttttgagacagagtcttactttcgcccaggctgaaatgtagtggtgccatcttggctcactgcaacctccgcctcccgggtccgagtgattctcctgcctcagcctcctgagtagctgagattacaggctcttgccaccatgcccagctaatttttgtatttttagtagagacggggtttcatcatgttggccaggctggtcttgaactcctgacctcaggtaatccgcctgcctcggcctcccaaagtgttgggattacaggcgtgagccactgtgcctggcctcaaagaacttctactatatacttggtgattatttttaaggtttaaaaaataatactaaaagctggttccttggagcagaaggctcaggggcaggctggggtgatctcacccacttcgtggtctctgaggaccggctctgaggcaagtgggggatgtgcggggatggcatggggaagggtgcacgatagagtgacaagagctgagccaaggacagtgggagaaacagacggggaggctggcaggaaacgtggagctcgggtcacccggtgggagtggtggccactgggtcactgctggaaggaggtgcactcaccggagaccctgggagcccccaaacagggacagctcatccagggcgaagtcggcattgaggaaggcgaagctctccaggatgcactccatcaggctctcggccgaggtgtgctcctgccgtgctctgcagggctgtggacgaagtggccagacctgagggcaacaccgggccccacccacccgactgggacactggccaggggcctcacggcagacttgggcaatgtcccggtcccaagccccaatcccacacaccgtcccccagcagaagcccagccgctggcccaaggcgtggcactgggcgtgtcaccccccaaagtccctcctgaatggcctgtgacaaggtaggagcagaatcttgagggggacagatctgaaaaccctcccctgtatctcagacacccacggggacaaggccaatggcaggagtgagtgagctgccccagcggggaccagggaggcaggagcgcaggtgcctcccctaagagggggccacgctcatagatcgcccagttctaagaaaaccctaaaacatggatatttatgggaaactgcccagctttgaaataccaacaacaaatttcaaagtattttaaatacatggtgtaggtcaggcaaacgcttcttcacgaggctcagaggcctgtgggctccaggttcctcctccctgttgggtttctctccccaacagattaagggagagtgttggggccaccaacccgccactggtcaagtcaccagagcctccagtgccagctccctccctggagatttctgtcttgtccccaactcgtggctggctctggggctggttcctgcccccgttcccagcacaccccacccaggccttgtgtccaacacaaactgcagccaaggcacagcccaagcagaagccataaaaccaaaccaggatcctaactgcggagccaaagagaaaatcttgaggacgaagggaataacaaggctagttgcagagatcacattttccaatacaaaaatataggcatacatgtgtatgtaagtgtgtatcaatacacacatgcatgtagactgctgattctcaatagtcaaggtagttatgttctagaggccaaggcgggcagatcacttgaggtcaggagttcaagaccagcctggccaacatgatgaaactgcatctctactaaaaatacaaaaattagccgggtgtggtggcacagacctgtagcctcagctactcaggaggctgaggcaggagaattgcttgacccggggaggcggaggttgcagtgagccaagattgcaccactgcgctccagcctgagcgacagagcaagactccatctcagaaaaaaaaaaaaaaaggagggggttatgttctataaaatcacagcaaaaaaactgaatcagcaaaagctgaaccattgctcctaagggagttactgggttaggttcctgtgaacctctggtcacagcagttttatcaactcagcaatgcagaactttgtatgtgtcttttggtttaaagacaccttatttaatagctattgttggctgggtgtggtggctcacacctgtaatcccagcactctgggaggccgaggcaggtggatcacctgatgtccggagttcaagaccagcctagccaacatagtgaaaccctgtctctactaaaaatacaaaaattagccgggcatgatggtacgtgcctgtaaccccaggtactagggaggctgaggcaagagaatcacttgaacccaggaggtggaggttgcagtaagctgagatcgtgccactgcactccagcctggacaacagagtgagactccgtctccaaaaaaaaaggaaaaaaaaaagctatttttgattcattaacattgaactcaacagccagcatcgctacaactcatgcctgaaggaagctcatctaacacacattttctctgtaaggtatttcacaggcttcctggactgaggaacaccagccggcactgaagctctgggcttgggaggcatttaaacagtgaaactgtcaacaaaaagcacaaaaacttgaaaaacatggcattaaatagaccatgaggacacttgtttaccatttgggcattgaaacaggaaggcaaagcattgcctcgcttgacctcagctgggaatgtgtgctttgagcagctcagattttctatcactctgcccggccccaaaacccactttggaatcgcctcgagtattgatttgggggttagaaataaattttagcaagtaagtaaattccaaaatgcagaatccacaaataatgaggataaatcatgtatatgtatgtgtgtatgtatgcgctcacacacacacttttttttcttttgagagagagagtctcgctctgttgcccaggctggagtgcattggtgcgatcttggctcactgtaacctccgcctcccgggttcaagtgattctcctgcctcagcctcccaagtagctgggactacaggtgcacgctaccatgctcagctaattcttttgtctttttagtagaaacggggttttgccatgttggccaggctgctgttgaactcgtagcctcaagcaatccacctgccttggcctcccaaagtgctgggattacagatgtgagccactgcgcccaccatcatatacacatagatttgcataaatgtgtgtgtgtgtaatttctctccagaaagtcaaaccaaaaaccacggtctgtaatcaatttgcattgttctgacttcgtttgccaaaaaaagaaaagttccttaaagacgtttaaaatgattacattattgcggcattaacatttttatgtaaattgggtgtaatttttcaaaatacaagtatgtgacaaatgtgcatgccgactcaaattagtctacaaaaaaaggctgttaaaaagtacaaaaaaggtacaggcacgatggctcacgcctgtaatcccaacgcttcgggaggctgaggcacgaggattgcatgagtccaggagtttgagaccagcctgggcaacaaagtgagaactcgtctctataaaaaataaacaaaattagccaggcatggtgatgtgtgcctgtagcctcaactagtcaggaggctgaggggggaggatcgtgtgatcccaggaggcagaggttgcagtgagccaagattgcaccactgaactccagcctgggcaacagagtgagaccctgtctccagaaaaatgaaaaacatgaagtaccaaaaagttgacattatttcttaaatttttttctggaaattttcaggcaggtcctttttaacaaccatagtagtggtaaacggaacatattttaaagttatggatgtaaaatgagaaattaaactttttttcccctatgttgatttgtcctgttggaggtgtggttggcgataaaatgtgtttgaagagagctgttaactatttcagtgccaaagtgtatcttacacaaaagaggggaaaacagaaaacagcaaaatcagagaagtgcacagccagtctgagggcataaggaccgagggaacacagagcaggaagggatgggcctgccggggccaggtgggagttgccatttaaaagagggtgtccaggccaggtgcagtggctcacgcctgtaatcccggcactttgggaggctgaggcaggcggatcacttgaggtcaggagtttgagaccagcctggccaacatggcgaaaccccatctctactaaaaatacaaaaattagccaggcgtggtggtgtgcacctgtaatcccagctactcgggacgctgaggcaggagaaatgcttgaacctgggaggaggaggttgcagtgagccgagatggcgccgctacaactctgttgccagcctgggcaacagagcgagacttcatctcaaaaaataaatacataaaaaataaaagagcgtgttcagggaaggacacccttaagttaattgatgtattagtaggtactagtggtatacatttttttgatgtacattcaaatttgtgtaaacacgagaggagaatgtaataatttgcctaggtcagcacctctgaaagccacctgccacctaagccctcctgtgaactgagaacagccccggggtatgagccctgtggagaaggttcagtgcggggtgcgtggatgaggcaaacagggaactgtgtggggccttccatggagccagctgcgaccctgacaacactccaagtttgggtttgtagccacaagccacagccccgcccacccaggtcagaaggtgcgagatggggccagtttctggctggatgtgcatgagcctatctactgtgaactcttaaaatcttcctgagccccatgagggctgttgttatccccgcttgccagatgaggaaaccaaggcccagagagacacggcccacccaggtcacgcagaggtgaggccaggatgtcggcccaggctgcgtggccccagagcccccgactcccagtcatcatgccatcagcaaagcagggccaccgcccggggcggggtggccataccttcagccggtcccggaagccgaggacctggtactccagctcccggagctggggctgggtggagtccgtgggcctcagcaactccaggacctcctgcagaggcccctcgagggccacgccaggcccgtcctctctgtccccggttgccccttcctcgtggccgttctggctactcgaggctgtgccgctgtggaacagggagccctgtggcaggctggggctctcccctcctaagttcctccagccaggctgctctgcaaacgggcctccagagaggtgggccatctctggcaggagacctgggggcagggggtcctcccgagcctcctcttcaatggaggcgtggggaccgaaggtcaagggcaggaagcccacatctgaggtggacgccgacgtgctggtctccgtgtctcgggggtcctcagagctgaaggagtccatctcaggcagctcctgactctggcttcttaggctgggaccccggaggtcgctgtcagacaggtagctgaggatggaggtggcccttgggccacccagcagcaaggcctgctgtgttggctgctgtaggacagactggagaggggacacgggagcggcctcaccagccaccccagggaccacagcaagtcccccagaggggcttcccctgacagacacccgctgtgcatgcccatgttctcaggatgactgaggcctgccgaggtgaccagcatcccagaggtgcagaaaaaaccctgtcccctctctgcacttatcccccatcccgcctccaactcactccccccaacctcaacagcctcctggctattgctcatgccctgtgggctgggccccacgttcctgcctcagggcctttgcactgactgtgctctcgtcagaacactcttccccatgtgccttcatggcttgtgccctcgcctcctcaggaccttacataggtgtcacctctcctgagaaccctgtcctggacagccttttttaagtggcaatttctacctggccccagtgggccccttcccttcctgctgtctcccacagtccttatgcccctggggctggctgtgcacttctcggattttgatatcatctgtttcccctgtagaatttcagctccctgagggcacagtctttgcctggcctggagcagaggctggcatatagtttcggtttttgttttgttttgttttgaaatagtctcgctctgttgcccaggctggagtgcagtggcactatcttggctcactacaaccttcatctcctgggctcaagcaattctcctgcctcagcctcctgagtagctgggattacagtggcactccatgacgcctggctaatttttgtatttttagtagagacggggtttcaccatgttggccaggctggtctcaaactcctgacctcaggtgatccacccgcctcggcctctcaaagtactgggattacaggcatgagccactgcacccagcctagttttggatgaatgaagtgaatgaatgaatgaagggcctgacaaacacaccatagaaacagcagcagctgtcattaagtattctgaggttgccggccctattccagggccttcccattaccctcaccacaccccatgggggtggcactgccctaacctcggagaggtccttaggccacacgggtggtgagtacagtgccacagtgtgaatctgggtacacggacacgaacccttacctctcatcagctgaaccaatgataatggttgatgttcattaactcagttaactctcacagtaatcccataagggcagtgctgttattctcacttctctgatacagaaattgaagtccagagagggctgggcacggtggctcatgcctgtaatcccagcactttgggaggccgaggcgggtggatcacctgacgtcaggagttcaagaccagcctggctaacatggtgaaaccccgtctctactaaaaatacgaaaattagccagatgtggtggcgtgtgcctgtaatcccagctactcgggaggctgaggcaggagaatcgcttgaacctgggaggaggtggaggttgcagtgagctgacattgcgtgactgcactccagcctgggagacaagagcgaaactccgtctcaaaaaaaaaaaacaaagaaaaaaaaaggcgtatacacttgctggtagatggattgctgtctctggaagaatatggaagaaactgatgacaggagttggtattaaggaggggaccctgatccatggagatcaacaggaaagatgttttactgggcactctgtcaagtactactactagaaacgtatatattaaggccaaggccatgactggggtgctagaaccatccagagagcccactgcagatgtcctgaagaaccagccaagcccagaacccaggctaggttggaggctggcagcagaggaagaaagtgcacaggaaaacacccaggatcgcctcaaacggaagctgagcccgaggcttgccatgtctgggagggccagactgctcagcccagctcctgcgtgctgcccccatcccagggtgaccacagcggccctgccccgggaaggctcactcaccaggtagtatctctcccggaagctgggggtgctcgggggtgtccagttgtacaaggagcccttcctgctgcccatagaaaacttgcccgtggggctgggtgacaccaggaagctctcagtatcaaacgggctggaggagagaacagaaggtcaggatgccatcggcacccagaggccatttcaggcccagacggcccacagggctcttaggttatgcaggtagatggtcttcatcttacaatacaatagcatggatggtgtgtgaggagctctgctctaaactgttgcttgtttttgagacagggtcttgctgtgatgcccaggttggaatgcagtggtgccaccacagctcactgcatccttgaactcctgggttcaagcgatcctcctgcctcagcctcctgtgtagctatgaccacaggcatgtaccaccatgctggactaatttttaaatttatttttattttttgtaaagacagcgtcttgccatgttgcccaggctggtctcgaacttctgggctcaagcaatcctcctgcctcagcctcccaaagtgctgggattacaggccatgagccactgagcccagcctctactaaactctttacacaaatccttatttccacccccaagacaaccctctgtggcctggagaattatttacaggggaggaaaggaaggctctgagagatgagtgacttgcttagggcagtgtcacaaccaaccacgcgagacggaactgaattcacacacagattttctctgaccccaaagccttaaagatcactaagagtgatgcttactcttcagacatcactgtacttaatggatttaagaggaaatgggctgggtgctgtggctcacacctgtaatcccaacacttcgggaagccaaggcaggcagatgacttgagctcaggagttcgagaccagcctccataacctggcaaaacccccgtctctacaaaaaatgaatacattagctgggctaatgtggtgaccaacagacacttgtagtcccagctactcaggaggcagaggtggaaggagcacctgagcctgggaggtggaggctgcagtgagccgagatcatgccactgctctccagtctggggcaacagagcaagactctatctcaaaaaaaaagaaaaaaaaaaaaagcaaaataaaacaggaaatggaggcttgggcctccaagtccagggccttgcccatggtcacaggtgcagcctaggaactccaggttacatgacctctacccctttagaaacctttctcaaggctgggcgtggtggctcatgcctgtaatcccagcactttgggaggccaaggtgggtggatcgcctgaggtcaggagttcgagaccagcctggccaacatggcgaaaccccatctctcctaaaaacataaaaaaattagctgggcatggtggcaggcacctgtgatcccagctacttgagaggctgaggctggggaatcgcttaaatctgggaggcagatgttgcagtgagccgagattgcgccattgcactccagcctgggcgacagagcgagactctgtctcaaaaagaaaaaaagaaacctttctcagactctgaccgccctgagggcccttagccagatggtgagggacagtgactgtgagcaggagagcaggatctggaggcaggaaacctcaggtcaattcatgctaaatcaaggaaagacaccaaggtctgaagggacagggaatctaaggccaattaacgcaatcttcctaaagctaacccaaaaggaaaaaccccgtctccccacactgagtagtaaaggatcaaaggcaacgctccctacagccctcctgcctccaaccatggctcagatggaaagggagggtgtatggatgggccgctggcgaaacagggaccatccctctatctgcatagggcgccatccacctcagcctctaaccacagaccaaatcctttatccagaaaaggggcagcccataggaacctcaaacagggtacttaaagcccagaaactttgaaaccatgcccttgagccacatgctcgggcccactcccaccctgtggagtgctttcttgccttttttttttttctttttctctgagactgtcttgctctgtcacccaggctggagtgcggtggcgccatcttggctcactgcagcctccgcctccccggttcaagcgattctcctgcctcagcctcccaagtagctgaaactataggcccgtgccaccacgcctggctaatttttgtgtttttagtagagatggggtttcgccttgttggccaggctggtctcgaactcctgacctcgggtgatctgcccacctacgcctctcaaagtgctgggattataggtgtgagccaccgcgcccaacctgctttcttgctttaataaagtcctgctgcttcattcctgcgtttcattcccctgctccttttctgcattttgttcaagtctttgttcaaaatgccagggacttggacaactcattgtcaagaccctccaccagtaacaactggacacccccagttagaggcccctttgagaagctcagccgatgagcaggggacactcggttcagaccccttgtctgtaaaaggggtgcgcttacagaagaacccccatgtggaacatgcacagggaagggtgggaatccaggcgagcgcatgggagcaccgaggcaagtgatgctcagcctggcccgtgatgctcagcctggcctgtgtccagccttgcactcggagtaggtaggtccccatagatccatttgcctcgaagaaacttgcttataattatttgcacaaaggcctggctcgtggcacctgggcctggcctgaccagaaggcctagagctcagaggctctgcaagtgcccacttctctgcccagggtgtctgcagacccgcaggcaccctgggtcctaggcttggatggcactgagctgcccgccaccctgtacacttcaggggcccctgggcgaggggtattctcagccctaccagacaggtgaggaccccgagggtgcaggtggtcgctcaacagaattcacccagctcacgagggagagggcagcagctttgtgacccccagctcggacacccaccctagggagagaggagagagaccagccccgactggccagagcaagcacagagcagaggagtgtcctcagccctcccttctgctgcctctgcgctgaggaggaggaaaggaacaccctggaaatgcaaggcttccttagaacagagagctctggagccctccacgctcatgggcatgcagtccagggagtgatctcatggacatgggcttcatgggtctgcagccgagagggggacgcaggtgaccgctcagccccaggccaagggggcagccagggtcggccaggaatgagggggtgggagcagcaaggagggccttcctggagaggtgagcctcctccaaggagccaagcccgggaggccccggaaagtgtccccccaaccttccctgtggctttaatagtcaggggttcagaagcaagaagggaagcaaaaccagaaaggcaggcaggggctacagagaagttctaggcctcgacctgactgaggggtgggagtgagggacagatgaggacccgtgagggcagggacacccttggcagaggctggtgcaggaacccagggccagagtgtggccaggccaccaggggcagccagccaggcctccgctctccccaggctggacgggactcacttccactgcacctccagctgcagcttgatggtacccaactccgtgatgtccaccacgatgacctgcggccgcgtcgtgaagaagtcggcgatgtcacacgtcactgcacccacagccagcgagcccaggccccgcaactccgtcacctgggggtgggggctggagggtggtgtctgagccgaacacccaggcaccccagccctgcccccgggccccatccccaccttgatgtccaggttctcatgcagcgtggggatgaaggccttctcctcttcgtcccaggtctggctgtcatctgactcgatccgacccttgagcttccaacgctggcggcccagacgcatgagcacctgtgaaccagcccgagaggggccgcgtcagcccaggtgggtgtccccttgctgtccgcccagggccctccctgccaggcagagccccagctgcaaccctggttcccagcagctcccgtcccccaaagacctggcggggagccctgaggattgaccccagagagtggccgtacctcatagtggtctccgggacagaggcgtgcgtagcccaccaagcctggaacacagacatggccggtctcccctccgccttccactctccctgacctgggaccacaggtcctctctggggttcccccgagtatagattttcagtttcagtggggtgaggatgggggggaggtacaccatcatgatggaaaatggacagagggtgctgggccctcacaccaggctcagagaggggtgggacttgccagaagtcacatgtcacatggatgcaaaagccagggctgggctcagacccctgggattctggccaattcccgtgcccctcagcagaagtctcagggcctccagaaaggcctccgcccaccccctctcagccctgttacctttcatcctgatgtggaactcgcccaggtgaacctccagggccccctcgatgagccacatgtcctgcaaagccccggaggtggctcagctggctgcctggggctaggccacgagggcctctaaccatccctgcagccagacagaggccacaggcagagagacgcctccttggggcccagaacacctcctccagcccccactggcccagctctcgatgtccccactgcccggcccagctcttgctgcccctgctgcccagcccagcttggcccggcccacctcggcgcactcgtgcaggctgcggcccagctcctgcaggctctctcgggctgcgcggctcggggggcaccgggcgaaggcccgctgcatgctggaggcgccgtcgcgcaggcggcactggatgcagtagtcctcgtacagctcatccacctgtggtgggcacacgggctggtggcgctgcccacgcggaggggcggccccacacctgcctgtcgacttctcctctctgggagaggccctccctgagctaagcaccccgctagcccagcccatggtgacagtcactacctgtccagtcccattcaaagcagtcacccctggccccagtagaacatgaacccccataggcagggaccacatctgcctcacctgcctcacctgccaccactgcctcacctgccacccctaccacccctgcctcacctgccacccctgcctcacctgccacccctgcctcacctgccacccctgcctcccctgcctcccctgccacccctgcctcacctgccacccctgcctcacctgccacccctgcctcacctgccaccccggcctcacctgccaccccggcctcacctgccacccctgccaaccctgtctcacctgcctctcctgcctctcctgccacccctgccaaccctgtctcacctgcctctcctgcctctcctgccacccctgcctcacctgctgcatacccagctcctggcagcgactggcacacagtgtgcacagcaaaaatgagtgaaagggacaagggaatctgtcccttcacctcctctgcctggtttttcaacaatgaaatgggagatgactttgtgataacctgccacccactgggcagtgtggggagtaaagcaagatcatgaaaccgtttgcagactctaaagcttacagatctgctatgcgaccttgggccaacccatgttcatctctggacctctgcttttccaactgtacaatgggctgggagggctcaaccttcccagccatctaagactgagcatgaggtctttctgcataaactgaagaaagagcccacacagtcctcagggagtcccacctcagggctgagccccctgactcccacctcagggctgagcccctgctgtccttcaactggcccgaggcccctgctcatccttagcctcctgcagctgccccatacccagaggccctgatccctgtttcgagggcacctccccagctcctgctaacctagctgaggcccagcaagctggcactgccccaccccaccctgcaacatccacgagccagctgaccttgctgatgtgaaactccatcttccgaatgtgcctttccacacagcgcgtttgcttctcccggaaaaagggaagatgtttgcaaagttgcctgggccacccacctgccccgcttgcccctgccaccctcctacaggtcctaactcagagaatggggcccctcaccatccctgaggaaggctcatcgcagagactcagccttcccattcctaaaatggggaggagacccaggttttctgcccatcaggcagccaggaagatgcaatgaggcacagtcattctcatccagccaggcccagcccacctcactcaccgtatgcagactcaccttgtccaggtcataatagaaagcctgtgagggaggaaaggagggcggaagaagctgtcagagtcccacatgttcctccaaggcctatgaggctctatgctggcggcgcctgagctcagagtcagaggacagaaagccatgtctacagccacccccacccactccttcctctgccaacggcagactgctgtccacgccaaggacagcactgattaaacacatgcacgtgggatgaggcagttctaggtctggctcttctatttcccagctgcgtgtcccaggcaagtcattcagcctttctgggcctccgtttcctcctatgtaaagcagggtaggagaagcgcctacctcacagggagaaaaaaggacacagtaggcccttgacaaaatgggaaccattgagattgaaggaatggcctcggccatgacaaaagaacatgagggggatggaagcgggaggggcacatggcacagcagttcaggccttaatggtgaattcctaagtctatccattccaggggccagggtgcgaccaacacaaataatatatcatcagggcaggcaaacctttctataggtttgtaaagggccagagagtaaatatttcaggcttggcaggccacggcgccccatgccaagatctataaagtaggaccatcctggccaggcgcagtggctcacgcctgtaatcccagcactttgggaggctgaggtggtcagatcacttgaggtcaggagtttaagtccagcctggccaacgtggcgaaaccccatctctactaaaaatataaaaagtagctgggtgtggtggtgcatgcctgtaatcccagctacttgccagacttgaggcaggagaatcacttgaacctcagaggtggaggttgcagtgatctaagaccgtgccactgtactccagcctgggtgacagagcgagactccatctcaaaaaaaaaaaaaaaagaaaaaaagtaggaccatctaaaacatacacacctttgcctaccttagagttacttctagaaccaagaaagagtgtgaagtggacctaagacatgggaagtgctgtacctgcctgtggggttaaattcatcagggtcaaagttttgtcctaactaagcaactctgccatcatagtgggaaagcagccacagacaatatgtacatgaacaagtgtggtcaagaaacatttttttaaacaagtgtttaaaaaaactcttgttttttaagtgactctaattttaaaatatagtgactctaattttcactggctgttaatttccagtggagattagagtcactatgtctgagtctggaggggttaccatggggttgtagatccaccagggaggaaaagtaagctgtaggagagtatgtaaattgacatttcatttttgtaagacaattttaactcacaattgctaaacacatttacatgattatgtgaccagagagaaaaatatggaaagatcaataaaagattgttctcaagggttaaacgggatgggacacggaagattgaatagaggagggcgtcaatcgagaaagaaagaaggattcaaccccaaaaagtcccatgtatgtatttatgtggaattgtacatatgcgataatgaaataaaaattccatttaagccaggtgaagtggctcacacctgtaatcctagcactttgggaggccaaggcaggaggatcacctgagcccaggcattcaagaccagtctgggcaacacagcaagaccccatctctacaaaaaatttaaaaattaactgggcatggtggcacacacctgtagtcccagctacttgagaggctgaggtaagaggattgcttgagcccaggagtttgaggttacggagagctatgatcgtaccactgcacttcaccctgggtgacagagtaagaccttgtcactttaagaataaataaataaaatctttttaaaattaagaaacaattaaaactccatttaagaaataaagaaacaggatgggtgtggtggctcatgcctataatcctagccttttgggaggccgaggtgagtggatcacctgaggtcaggagttggagaccagcctggccaacatggtgaaaccccctctctactaaataaaaaatacaaaaattatcctggcatgattgtgcgcgcctgtaatcctagctactcaggaggctgaggcaggagaatcacttgaacctgggaggcagagtttgcagtgaatggagatcgtgacactggactccagcctgggtgacagagcgagaatccatcccgaaaaaaaagaaaagaaaagaaaagaaataaataaagaaagaggaaagatcccaagcctttgaaaagaagagtgactacccagcaacgtctcaaaaaccaacatcttgtttcaatgagaaccagcagtgtcatgggagcaggactcgacatgggcatcttgctgtgtggctccagtgcggtcactgtgccctggcctcagtgtgcccatctatgacatgggagcagctaaaacatacaagtatttatactcttgcctgctttagagttacttctagaatggaaagaatgggaaacgaagtccacggggtgagactcactgtacccatgtgagaagaggggcaggtgctggagctgggtgatatcttggcagcaccttctcccaccatctgctgctggtcacccgcccaactgtccactaagggtgaggcatgctgagcttggcaggcctttccctccccaagtccctggcacacacatgaggctgggtccttgcctctcctaccctgcccaccccgaggccctctctgctggagccaggatacagagacggccgcttgtttgcttgcttatttcattcattcattcattcattcattcattgaaacagagtctggctctatcgtccaggctggtgtgcagtggtacgatctcacctcactgcatcctccgcctcctgggttcaagctattctcctgcctcagcctcccgagtagctgggactacaggcacccgccaccacgcctggctaatttttgtatttttagtacagatggggtttcaccatgttggccaggctggtctcaaactcctgatctcgagtgatccacccgccttggcctcccaaagtgctgagactacaagcgtgagccactgtgctgagccactggatgctattttggtagaaaaactcatctcccctcctcgctttcccagtccctcagtcaagctggtggcctgttctgcacattggtgctttggaggagggattctgggaaacactggctgggaggagaatcccacagtagcaaggcctccttgcttttgtctccaaatctaattcattaaggacatgtggggttttctcaaggcagcagcggagagacttcccagatgaaaggaagatcctcctgctgaaaggatgaagtccctgagcaatgggatcctagcagtgtcaccagataaaatacaggacacctaattaaaattaaaatttccaatcaacaaggaacaattattttagcataagtatgtcccaaagattacatgggatatacttatacctaaacaaatttgtgatttgtctgaaaaaccaatttaatgggaggccgggcacagtggctcatgcctgtaatcccagaactttgggaggcagaggcaagcgaatcacttgaggtcaggagtttgagaccagcttggccaacgtgaaaccttgtctctactaaaaatgtgaaaaaacagctgggcgtggtggcgggtgcctgttatcccagctactcaggaggctgaggcaggacaatcgcttgaatctgggaggcagaggttgcagggagccgatatcacaccattgcactccagcctgggcaacagagtgagactccatctcaaaaacaaaacaaaacaaaacaaacaaatttaatggggcatgctatttgtgagtgtgtgtgtgtgtgtgtgtgtgtgtgtgtgtgtgtgttgctaagtcggtctctgctaagggagaggcaaaaaaccagagcaggtgagccttgggcaacacagggcccagggccagcctgaaagacactgccttggctggcacagtgcctcacacctgtaatcccagcactttgggaggccgacacaggaggattgctggagcccaggagttcaagaccagcctaggcaacatgatgagaccctgtatctacaaaaaatttaaaaaattagctgggcatggtggtgcatgcctatagtctcagttacttgggaggctgaggtaaaaggatcgtttgagcccaggaggtggaggttgcagtgagccgggattgtgccactgcactccagcctggacaacaaagggaaatcctgtctcaaaaaaaaaaaaaaaaaaaaaagacactgccctgatgatggcaggaaacgctgcctgtcagctgggcattgaaggaacacgcaggcttcatcaaggacagcggcagaggccactgtgacatacccaagatgtgacacctgacccactttcctggcattacagaagccatcccaagtccaggtcacctgatggccaaggtctataaaataggaccacctaaaagaaatgcacctccatacactgcccaccttagcattacttctagaaccgagagacagtgtgacatgggcctaaaacgtgtgaactgctgtacgtgccaaagtgaagttaactcagtgcaacgtgaagaggctattccataaacctctagttctgagaaagagtcacaccgtgacataggctagaaggaacgcagggttcatcttttactcctggccaaggctatctgggtgggaagcaggcagggaggggtctcaccagcctggaattcctcctggtgtctttgtggcgtccagacaggtggtccagctcagcctgctgcacacacagatactccctgcaaggaaagcaaggaagagtttcaaatggaagaggaagaagaaagggaaaggaagtaggccaaatggacaatgtccccacgtggagagcagacacggggctcagcggggctcagaggcaggtaggaagccaggctccctcacactgggggctgtgtgcccagcaccacacaaaattggttacagggaagttcctagttaattcccccaccaggcccacaagtagcttctactgttattatatgcattttctttctttctttacttatttattgtttgagacaaggtcccccctctctcgcccaggctggagtgcagtggtgtgatcacagctcactgcaacctctacttcctgggttcaaatgattcttatatctcagcctcttgagcagctgggactacaggtgtgtgccaccacacctggctgatttttgtatttttagtagagatggggtttcactatgttggccaggctggtctcgaactccttgacctcaggtgatctgtctgccttggcctccgaaagtgctgggattacaggggtgagctaccgcatccaacctagtatatgcattttaaagatagacaaaccaacccttgaaagcagcaagtaccccagccccggtcacacagcagagaagaggctgaacccacgtctgaaaccacacagtggccttctgagcccaaaatcttcatccccatgttataccccctcccaagctggggcccagctcatggggaggtcatcatggcacacctccctcaaggtcaagggtctaggccgggcgccgtggctgacgcctgtaatcctaacactttgggaggccgaggtgggcggatcacaaggtcaggtaatcgagaccatcctggctaacacagtgaaaccccatctctcctaaaaatacaaaaacttagccgggcatggtggcacacacctgtagtcccagctactcgggaggctgaagcaggagaattgcttgaacctgggaggcagaggttgcagtgagccgagattgcaccactgcaccccacctgggcaacagagcgagacttcattccaaaacaaagaaggtggggggcgtctagatttgggggccaaggcagggagtcccatcttgctggatttgctgagtcatcccaggaaggtcactcacactctctgggctctactgacaccacctcaaatgtggaaaagatagcttctgccagactgctactcactgaggtattgagctctctgggaagaaggggctgccttggccccagacaagtctcaaacatgtggtccttaaaggacacagaatctgtccttcagaaacatgctctatcgtccatgcacatcccagctcccactctgcacaatcccagcttgctgcagcctccacctctacaggattttgccatattcccatgctggtcttgaactcctaggctcaaggaatctgcctgcctcggccccccaaagtgctgggattacagggtagccaccgctgtgcccagccaaggatgtctattttgaaaaccatttcattctaaggtggtttccctttttttttttttttttttttgagtcttgctctgtctcctaggctggagtgcaataacgcgatcttggctcaccacaacccccacctcccgggttcaagtgattctcctgcctcagcctcccgagtagctgggattgcaggcatgccccaccacgccggctaattttgtatttttagtagagacggggtttcaccatgttggccacgctggtctcaaactcctgaattcgtgatccgcctgcctccgcctcccaaagtgctaagattacaggcccactgcgtctggcctggtttcaacttttacttgactctggttcctctttggggtgccccatctataaataagagatgtaggggctgggcgtggtggcttatgcctgtaatcccagcactttgggaagccaaagcaggtggatcacaaggtcaggagttcaagaccatcctgaccaatatggtgaaaccacgttctattaaaaatacaaaaacaaattagccgggcgtggtggcagatgcctgtagtcccagctcctcagaagtctgaggcaggagaatagcttgaacccaggaggcagaggttgcggtgagctgagtgagatcacaccaccgcactccagcctgggtgacagagtgagactccgtctcaaaaaaaaaaaaaaaaaaaaaaaaaaaaaaaggcgtaagtaggagagaatttagggtctaagtaccactatatctggggaaaatcactccagaaaccactctttggcccacagggccccctgtcatctggtccccattgccccataacctcatcctctttcctttggctctagccacgctggcctccttgctgcgccccagggcctttgtgtatgtggctaccctggcctggaatgttcttttccccttcaggagtgtgctccaatgtcaccttcttagcaaggccttccttccaactgcccaacttaaaatgaaccctccctgcctctgcctgcttaccctggcctgttttcctctgtggcccttactaccatctgatattctctgtacttttcttttctgtattgtgtattgtctgtctctcccccactaggagtcagctccacaggaggtagggattttgtgtgtttagtttacttctgtcccctggcctggcactctgtaagcccaataaatatttgtgggctgggcacagtggcttatgtctgtaatcccagcactttgggaggccaaggcaggcagatcacttgagtcaggagttcaagaccagcctggccaacatggcgaaacccagtctctactaaaaatacaaaatattggctgggcgcggtagctcacacctgtaatctcagcactctgggaggccgagatggacagatcacctgaggtcaggagttcgagaccagcctggccaacgtggtgaaaccctatctctactaaaaatacaaaaaattagccaggcgtggtggcaggtgcctgtaatcccagctactcggtaggctgaggcaagagctactctcagcctctgctttctcatctgtaaaataaggaggctatgccaggtgcagtggctcacgcttgaacccaggaggcggaggttgcagtgagctgagatcacaccattgcactccagcctgggcaacaagagcaaaactccgtctcaaaaaaagaaaaaaaaaaattagccaggtgtgatggtgcgtacctgcagtcccagctagttgggaggctgaggcaggagaattgcttgaacccaagaggcagaggttgcagtgagctgagattgtgccactgcacttgagcctgggcaacagagcgagactccatctcaaaaaaaaaaaaaaaaaaaatttgtggagtgactcatccttcttgtgcaggcctcggcccagctcatcagttggtctctgagcaagtctgtccttcactcaaacacccaccgccctgacctcttgcgtgtgtgggctcacagtgcaggctcctactgtggggcctttgcccacactgttgcctgtctgccgaggccctcgacgcactgtctctctgttacctttcttcattgcactcagcacaggtggaagttctatgattgattgcattgcttcttgattgattgcattgaatctgcccctctgcagtgcgtgctccacaagatcagagtcctcctgccttagtcactgccaggtttccagtgcccaaggaccgggctgagcacgcggctgcaccctgacatacttgcttactaaacgaatgaccaggaacttaacctgtcacctcttgtagacaagacccatccacgcttccccaggaagagacagagaggaggcgaggtagaggaatgcacttcttaaaggcagcacacagcccagccttacttgaggcctcttttcaatgcttcgaagatcttcttcacctgctggggcttcgggtctgcacagaccgaccccttccgcagcgtgccgtacatcttggaggattttgcaggcattcgcgatctcacggagttcctgttgatggactttctgtgagaagggttggagggcaagagaagtcagagaagggccctgacaaagccctccccaggggcaggcactttggaaatagtgaccagagccacagggagtcaggagacccggctcagtcccacccccatcaccaccaagcagtgtggtttccagaaagttatggagcctctctgggtctctgctttctcatctgtaaaattaggatcctgggccaggtgcggtggctcacacttgtaatcccagcacttcgggaagctgaggtgggtggatcacctgagatcaggggttcaagaccagtctggccaacatggcgaaaccctgtctctactaaaaatacaaaaattagccggatgtggtggtacgtgcctgtaatcccacttactccggaggctgaggcacaagaatcgcttgaacccgggaggtggaggtttcagtgagccgagattgcatcactgcactccaacctgggtgacagagtgagactcagtcttaaaaataaataaataaataaataaataaataaataaataaataaataaataaaaataaggagcctagatttgaggattaaaagaagagtaataaagcttttccaccatggctgccactggagagcagcagccatggctctgcgctaccctatggccatgggcctcaacaagggccacaaggtgaccaagaacgtgagcaagcccaggcacagccgctgcagtgggtgtctgaccaaatacactgagtttgtgcgggacatgatccgggaggtgtgtggctttgccctgtacaagcagcatgctatggagttactgaaggtctccaaggacaaacaggccctcaagttcatcaaggaaagggtggggacacacatccacgccaagaggaagcaggaggagccgagccaatgtcctggccgccatgaggaaagccactgccaggaaagactgagccccctcccctgccctctcccggaaatatagaacagcttgacaaaaaaaaaaaaaagaacagtaataaaaatctggtatcagaaatgaacttacaggaagaaatacagtcaagtagcccaaatgccaatgctctctgatcaccatgctctgcctgtgcaggcaatgccgtgtgggaggccaagtcatagtcctgtgctttacccttggggcagcatctgttggctttacctgcccagcatccatcccctccctctagtagtagcacctcaattttcctctggggcacctccccagctctgctttttatacttgtggtttgggggaaaggtagcctgactaatcaacatgcacacacacatttgcacatgcacacatgcacacgggattgtttggcaaatccacattccaggcctgcgttagtcaacatattctgctcccctgggccaagaagtatggggatcaagcctggccagtagccagccaggagttcagaattcacagaagggagaagtgttttttcccctggcattgctaacctggggaacatatacctgggacttccagcctcctccttttgccaccatgtagggaaactggggccaacacagagaggaacaaacagagtcagaccaaatctccatgacagtgagttcctggatctagctatgtctaaagctgaacctgcccgtggactttgcagttacatgagccaactggctctcttttttagcttaagccagctggagttgggagtgtggactggatgatcctaaaaactgcctttcagtggtgatggctgggtccctcaacatttagagatgtagcagcatctcaagactgattataggagtacgaggccagggcaccctcatcacagcacagagctggtttccctggcatctaagcctcttctcaggatcccataacttatccatgaggctggctgatgcagcctttgctcaccaacagatgtgttgaattctgctcttagccctctaaagccatcagccaggcgccctggcaccaggcatcacttaatgacaacattctcacaaaagagacatggtggaaatgactcttagatctaactttggcatcagttctctttttttttttttttttgagatggagtctcactgtcacccagcctggagtgcaatggtgcaatctcggctcactgcaacctccacctcctgggttcaagcgattctcctgcctcagcctcccaagtagctgagattacaggcatgcaccaccatacctggataatttttgtatttttagtagagacagggtttcaccatgttgtccaggctggtctcgaactcctgacctcaaatgatccacctgcctcagcctcccaaagtactaggattacaggtgtgagccaccgtgcctggctcagcatcagttattataggggactactggcccttctcttccaactcctcctcttcccaggggcgggaataacggtatgctggaagcagcttcaacccacccctaaaagctggctgaacaacaagagagaaggaacaggccctgaatagcctcgtgaagcagacctcccaacacacacacatgccctcatccaccccttggctctggactgcagagagagagagagaggaataaccaatctcaagtaagcacctgcattttgggggtccttttatcaaagcaacttcacctctacattaacaacacactacccaaggctctgtcttttcactggtaaaatgggaccacgtaatacatcagaggatggtgctgagaattctattagatgccaggcccaaaatgtggcacaaaggagaccttttacatgcaagctgttgttagaatcatcacatcctatctgtatctttcccctggctcacagcttagaaaacattaggtgcaggccaggcactgtggctcacacctataatcccagcacttcgggaggccaaggtgggtggatcaactgaggtcaggagttcaagaccagcctgaccaacctggtgaaaccccgtctctactaaacaaaaaattagccaggcgtggtggtggacacctgtaatcccagctactcgggaggctgaggcaggagaatcacttgaaccgggaggcagaggttgcagtgagccgagatcatgccacttcactccagcctgggcagcaagagcaaaactctgccttaaaaaaaaaaaaaaaaaaagaaaaaaaagaaaatattaggagtttggtaaatattaagctcagctgaacgggggaaaatacagtatcccaaggggattagagaacagagaacctggcccctgcaggcagagcgggatagcgagtgcacccctgggtgttcccagctggagacagagggagcaaaggtggagaatgggacctggtatgctctgggagtggatgcaaggagcaaggtttgacccaggcagaagtgggagtctgcagaggggcctggacctggggcctctctagttttggggacccaggatgtgtgagaggaggagaagggcagctcccagagaaagtccagcttccaacacctttacaatgacaagtaatgtctctgtagagcagagaaactaagctcaggccagggctagtgggctgctgaacagctgacaccacaagcccaagggcctcaggagcctggtgagaacacgtgagcctaagtaactgggggcacctgctgccgccaggagctcgctaagggctttatagaaatatctcgactttcacaaccaccctaggagacaggtattattcttattattattttgagatgaaatttcgctctgtcgacaggctggagtgcagtggcacgatctctgctcactgcaacctccgcctcccaggttcaagcgattctcctgcctcagcctacccagtagctgggattacaggcatctgctaccacgtccagtaatttttgttttttttagtagagacagggcttcaccttgttggccaggctggtcttgaactcctgacctcaggtgatctgcccgccttggcctcccaaagtactgggattgcaggcatgagccactgcacccagccatttgtatatatttaatgttaagtgatgctttccaaagcccacaggggctgtgctccctcttccccttgccctccctgaggccccatcacccacctcttgaaccgggccctccgcaagtttgccatcttgaggctggcagagacggtcagggctgcagactcgggaaaaggcaggtttctgagaggttagggaccccggcaggtgggcagcaggcagtggggcaggagctcgctcactcccagctcctgcctccagcccccaacaggtgtgcaccgttggcccagccccgcttccatccacctggggaccttataccctcgctgctgcagccacacctggatgcacctgctcccgggaaagctctgagcctagtgctccttgtgtgaggtttaacaggacaggctcagtggccactctgagagcccgcccacccggggaaggtgatgcacatgcagcctccagatggccaaatcaggcagcatgtctggcccaggtgtcacagaagccggggcaggaagagcctctggggccggatgtttcaccaggtctgggaggactcagtaaatattaaacagcccctggcatgccagacaagcttccagacgggcacgtgcaacctgccggccccagccctcacgtgaggttgctacagcagtccttctgcctggtgtggttggcagaggccttggtactcggctgttgcaagtgcaggctctggaggcagacagggccgggctcaagtcctgcacctgcccccagcctccaggcgggacaattataggactgactgcacaggcttcaggtgaagactccatgcaacaaggacgtgagccaaccatttacccaggtgcctggcggtgctggccactgggtgatgatgacaggcatgcactcggcacttgccaagctcaaattctgctctcagtgcttttgttttttttttttttaattgagacaaggtcttgctctgtctcccaggctggaatgcagtagcgtgatctcagctcactgtagcctccgcctcctgggctcaagtgatcctcccacctcagcctcctgagtagctgggaccacaggagtgcacaattacactcggctaattttttgtagttttggtggagacagggtttcaccatgttgcccaggctggtcttgaattcctgagctcaagtgatccgcctgccttggcctcccaaagtgctgggattgcaggcgtgagccaccacgcccgcctggcctgctcttggtgctttacatgtatggactcatttctcctgacacagtctttgaggtcaggccccctggtaccgtccaggaaactgaacttgcatcactcgcctctggctccagagtctgtgtgcttgacagcttcacaggcagggctggatatgagccgcctctttctccagcctcctctccttgaaacttaatggctgctatttcgttttcacacccacacttcttagccatcccaacagaggaattcccaagctgaggaggatgtcccagtggctcctggctcggggagtacctgcctgactgcctgggggagggagacctggctgaggaggggcaggaaagggggaagggcaaccatgcctgtcaactggggcagagtaggacagtatcggggcctggccctctcctccttcatcctcactgtttatcctctcatctctctatcctcccaccccccaggtccagctcttgggaaatggccttattatgtcaatcattcacaccttagtataaaatttccccaccaggttacttccccaagtgagccatctgactgtggagtaaaaatccctgtctatagtgaaaggggtttcaaggtgccagagtaggggtcaaggtggtgatgggaagagaaggggcatcagcccaccctctccatgcagagccctgccctcctgccaggttgtttgccttgacagtgcggctgcgcttcggcctgctcgggttaccagggaacaaggccagaaggtggggcctgaaacccaatcaggctccagccctggctccaagggttcagaccccagggagctcgacggagacaggaagttaaaaatagatgcaccgcttccccgtcggtgtgggcagcttcttccttgccctcacacaagggggcggcagaggccaaggccaggtgggggctgcccagggacctccgaaccagcccaggcccagcatcctctggcatccttgacaatcagatgggggacaggaggggtctgagatattagagccatcagggctgtctttcctagactaggacttggacactgtgggacccttgctgacggccagcgagccctggtgtcaaggggatggatcacctctgtcctccttcctcccaaagagctgatcccaggaatccaggaaggggccaacgagaggcagaggcctaccgtgggggcactctctgggcagagctcccctctagggcctgaggggacatgtcccatggatgcaggacattcagaggcccccacaggcctggcaggaggagagctgcaggcagggccagttgtgaaatttgtggggtctagtgcgaaataaaaatgcaaggctctttattcaaaatttatcaagaattttgggccaggcgcggtggctcacgtctgtaatcccagcagtttgggaggccgaggtgggtggatcacctgaagtcaggagttccagaccagcctggccaacatggtgaaaccctgtctctactaaaaattagctgggcatggtggcacatgcctgtgatcccagctactcgggaggctgaggcaggagaatcacttgaacccggcaagtggaggttatggtgagctgagattgtgccattgcactccagcctgggcaacaagagcaaaagtccgtctcaagaaaaaaaaaaaaaaaaatagccagtgtggtggcccatgcctgtagtcccagctactcaggaggctgaggcagaagaattgcttgaacctggaaggtggagcttgcagtgagcctaaattgcaccactgcacacctgggtgacagagcaagactctgtctcaaaacacacacaaaaaaattgtattaagaatttctatttggtgccaggcacagtggctcacacctgtaatcccagcattctgggaggccgaggcaggtggatcacctgaggtcaggagttcgagaccagcctgaccaatatggtgaaaccctgtctctactaaaaatacaaaaaaaaaaaaaaattaactggcatggtgaggcacacctgtaatcccagctactcaggaggctgagacaggagaattgcttgaactcaggaggcggaggttgcagtgagccgagaatatgccactgcactccagcctgggcaacagagcgagactctgtctcaaaagaaaaaaaaaaatacaaaaattagccgggcgtggtggcacgctcctgtaatcccagctactcaggaggctgaggcaggagaatcacttgaacctgggaggcggaggttgcagtgagccaagatcgcgccattgcactccagcccgggcgagagagagaaactgtctcaaaaaaaaaaaaattttgggaggctggggtgggaggatcatttgaaccaaggaggtcaatgctgcagtgaatcgagatcgcaccactgcactacaacctgggcgacagaatgacacccacaaaaatttctagagcacaacagcagagcgttcaatcaaagtacagagcacaggctacacgctcatgaagccgcccttgggtacagggtctgcagaccctacccctccttccagaccacacaagggtccctacagtgcttcagtggaccagccccactccagggcacacagctgggagagggtcacctgggccggatggccccctggccaggtaacccgcacagctgaccttcccagccttgattacagacccctgcaagaaagtgggggactctgataaagcccaggaagaggcagctcagaaatggttaagttgagaaacagcatcatttcctggccggtttatacttaaccccctctttgcagcacttatggagtgcctgctgtgtgcctttctcaggcagcacccactctttctgttctctgaggcttggagttggggcactgagcactaactgctctggagcctgggtcaaattcttctcgtcttggggcatcaacttaaacccttcccaggctcccctccactgagaatgtgtctcaaggcctcactgcagcccatgaggctccgcagggtcctcctccctccctgactgctgtcacgcatgccagccgcacacctgctttctgtcccttaaagctcattcccacccaggacatctgcactcgcagctgcctcccgccgccgaaggcttcccggcccacccccatctgcacacgcgcagatccacttcttctgtcccttcctgcctccactccccatgcccctgtctcgtcaggctctcccaggagaccatgggtgccctcccccacccccagttcagttccctcacagcactgccaccagctggatctgtctcaattatcactggcttattgtttgctgccatcagctcccaggacagcagggcctgggtctgtccccagagcccaggacagggccagagtaggtgctccgtgaatatctgctgcgtgaacagggattcctaaggtgcttccagctgggacactccaggatcttaaccctggggtcccggcaccaccacccatgggaagggagcccccagggaaaggttagtgagctgggagggctgacctcaggggggtggaggtggggtcctatccccgcagcaaatgcccctgggaaggagctcagggagcacacacaggagggacctggcctggtctggagctcaggggtcctcccccaggacctagcaggaagccaatgcctgcaggtgattcaacgggaactggaggtggaggagtggggtaggagctccagcgggaggacacacatgtgctgaggccctgaggccgggaggggagggaggtaggctgctggggccaggtcccaggggcctctagccaggagggcgctgggtttattctaagtaggttgggaatctttgcagggtttcaagtcggggaagagcatggtgggattttattgttgactgactcactgacctactgagttctgcactctgctctggctggggaccccgacctgtccaccccgttggctcagacagacagaggtttggccccttcaggatgtcgataaactgccccagtccccaggcctgcctgctcgtaaatggttccctgggggcttgcacagtgcctggcatgaggccctggagcgagggggcagcaggcctgagctcatcgggctgtggcctccagaagcagaaacaaccttcctcccagggacttagtacctaaagccggaggagacacaggacggggcagcaggcagggcctggcccggccagcacccccagggaactcagccacagggtcaatgctgccccccaggcccatctgtgccaagcctgctccctcatccggtaaccccccacagcaccagctgcaccggctgctggccctgcctccctcgtggttccttcccgacagccccgtgagcagggtgcacccacaattcccattgttcagatgaagacaaggctgaagaggtgaggtcacttgccccaggtcacagagccagaagaggtggccccattgcctagtcttccagacaggaagaacattccttcccaaccccgcccgtggaagacccaaccctgggccagttttgctgtgtgaccttgggccagtggctccacctatctgagcctctggttttttggtttttcttttttggtgtttttgtgggtttttttgagatggcatcttgctctgtcacccaggctggagtgcagtggtgtgatctcggtacactgcaacctccacctcctgggttcaaataatcctcccacctcagctttccaagtagctgggattacaggcatgtgccaccacatccaactaatttttgcatttttagtagagacagggcttcaccgtgttggccagggtggtctccaacttctgacctcaagtgatccgcccgccttggactcccaaagtgctaggattacaggcatgagccaccgtgcccagcccaattttctggtttttcaaaaaaatttttgtagagattgggttgtgctatgttgcccaggctggtcttgagttcctgggctcaagtgatcctcctgcctcggcctcccaaagtgctgggattataggcgtgagtcactgtgcccagccagagcctcagattttttatctgccaagtggacctgctaagctcaggcagatcaacttctggagactttgaaatgataactgttcaggtttcaaggaaatgataggtttatcccaacactaagaaactctgtctctctgtctctctctcaatctcaatctctctctctctctctctctctctctctgtctctctcgggctgcaagccggcctgagagtgggccttcgggtctctggcagcaggaggaggatgaccctgcccttccccagcccattaacaagccccacccctgcaccccgaaacaggacacggggggaacttacgcgatcctccggctctgtgcactgctgaagcctgcgaaggaggcgctccggcccacgacccccacggcccctgtgtccccaggggacaggaaccgcaacctcaccgacatggtggtcacctgcaaggagaggacaggagagtcagcctggcatcaccatccagcgagtgccgtccgcaggccagccaccttccaccaacacctacagacctcacaatggccccagagtgttgtgggggctggtactgtgcccagctcacaggtcagcaagctgaggtcccatgaggttaggggacctgatgggggacagtgatgggaatggaattcgaacccaggtgtctgtactctgcactctgtgctcaggtccttagtgccgggcaatgctgcctcccagagcaaggggacagcacctcctgaacacagccctctcaccccccgagcttctcctctcccctcctccagccctccctgagcacctaacacaggtgaactctgcaaggcaggccaagtccccccatcctcaagggctccagcccagcagggaggcccacctactgccgaacagttacgatacagagtccatgctggagttatgggggtcccagggggaatctgacccagccatgaagaggcgcccaagagctgagtaggaaggctgacgtggggtgaaggggaagggtgtctaaggccgagggaacagcctgggcaaaggccaggatgcatgaggggacttggtgtcatccagaaacagcaagaagctcagtgggctaaagacgaggtcagagaggccggcagggctcaggtcccaagaggcattggtagccccaagcaggggcttggccttacaatggggcaagggtgactgggagccatgggagggctttcagcagggggtggaaaagtccaattcacatgaagccagactgctggtgtcaagggctgcttccaccccgatccattgcccagtctccgacccgccctgcaatggggccaaccccgagccctggctgtcttctcttttttccaaaccatctctagattgagaaaatgccaccctatcccttgggaatataggtcagcatcttccagcaagggcagctggaaagttctgcttcatatctaacctaaatctctgctgctacagtttcatactttgctcctttgccagggtggtgtcaatccaaggattccagggaccccattgcccagacaaaacctacgaaaaagctccagtccacctcatcttcctgcacgatgagacccccatgttccaacatctctttcccccaggggccaagtccaccccactacacctctgctcacttgggggtctctgcctggaaaaacttcctgtatcgagccacatctgcccagcatctactactgcacctcctggcagatctgtgcagcctccacaagcctcctcctcccatatatcccccaccccacagccccacatgtgccgtacataggaaagcttggcaacaaagaaggtggacctgggctcaaatcccaactgtgccactcaggctctgggcctcagtgatcacaagagtaaaaggggaattcagaaagaacctcccacggagactgctggaaggaccaaggaaagcatgtcccgagagcccacagtgtgcaagagacatgtcggaagagctggctgtctctgtgcaattggctaagaccccagctctgcaggtgagccaggtgacccagataagccaggtgacccagggagagccaagtgagaagtgagcggcttctagcccggatggaggaaggtggcaagcatttgctgaccactcgctgtgtggcaagcctggtgccccatgagtggctacgaatccatgaacagctatgaacccatgcccagcagtgctgtgtacagatggggaagttgaggcatcattcatcaagtgctcattactaagctggccctgcactaaatgctttatgtaaattatgaaatccatacaaccctcttaagagcaggagcttttgatgatctaattccatagatgaggaaactgaggctcagagaggtgatgagactagcccaggagccccagcagggcacctgagcactgggtttagaacccgaggatgcccgatgtcagagcttgtcttacctgcggtcaggagagccttgcactggggccttgcccctgcccccataaagaggtcccctacagtcccctcctgtgctgtgctgagccagcttgtaccagctcccaacagtcaactgggccaggcacagtggctcacacctgtaatcctagcactttgggaggccgaagcaggcagattgcctgagctcaggagttcaagaccagcctgggctacatggtgaagccccgtctactaaaatacaaaaaattagccaggcttggtggcaggcgcctgtaatcccagctactcgggaggctgaggcaggagaatcacttgaacctgggaggtggaggttgcagtgagctgagatcatgccactgcactccagcctgggcaacagagcaagactctgactaaaaaaaacaaaaaacaaaaaacaaaaaatagtcaattgttaaatgttcaggaattttgtgagcctgttgacatcacgttggtggtttgaaatcagccacagtaaacgtatttacaccacagaaagcggcaagttctacaagttagggtttctgtctgctggttgttaaacacgtatgagctcctcactgctgttacccctatcagcacctatgcagggcctgagaagctgctcaaactgcttgatccccccagccaagccaggcaagagaataaggacggagtagggagggattcccaaaggtgagtagttgagacgtactccggagccagcctgggcactggagccggaaggggcttccccggcccctccctctgcaccttcccatcagaagccttctgggccgttcctggagcttcaccccagtcactccacttcaaggtcagagagaaggacaattgctaagcagttcctcccgatgcaaagctcaaaacaagccccaggtcctcctgctcagtgtgagagagaggacgacgaaggagggaaactaaggctcggagcagacctgcagaacctgacagcggattcatcactcatagcactgtgaggttcaatggccccatttttcatatgaggaaagaaaggctctgagaggtgagaggcgactcagggacacacatatttctttctttatttccttttccttctttctttcttttcttttttttttttttttttttagacagggtctgactctattgcccaggctggcgtgcagtgacacgatctcagctcactgcaacctccacctgctgggctcaagccatcctcccacatcagcctttcacgtggctgggactacaggcacacaccaccattcccagctaatttttgtattcattgtagagatagggtttcgccatgttgtccaggctgttctcgaactcctgagctcaagcgatccacccacctcagcttcccaaagtgctaggattatagccgtgagccaccgcgcctgaccaggacactcatttttcaaactgaagtctggctcttccttcttccacgtgccatggccacatggattggcttcctggctaaaccctcctcatctttcagcccagatgtcccctcccccaggaagccttcctggacacctccccactcctagctgtgtctggtgtttcctctggatgcccctgacctcctctgttatagtggactgtgaatggtgacttgtctatctctccatcctagacagggagctccctgcaggcagggaccaggtgcatggaagattcataacacatctttattgaaccagaaaacaatgaaggaaaggttgacgctgcttcccctacttcaccaggctgtgcagcccaagaggaaggtgctggaataataacagtaatactaatactaataaccactatgtgctagactctaaggcaaagatggacaaatgttttctgtaaaaagccagatagaaaggctgagcgcagtggctcacacctgtaatcccagtactttgggaggccaaggtgggtggatcacctgaggtcaagaattcaagatcagcctggacaacatggtgaaaccctgtctctactaaaaacacaaaaattagccgggcgtggtggcgcatgcctgtagtcccagctactctggaggctgaggcaggagaatcacctgaatccgggaggcagaggttgcagtgagccgagatcaagccactaaactccagcctggacaacagagctagactccatctcaaaaacaaacaaacaaacaaaaagccagatagtagatatttttggtttttcaggccatacagtttttgtcacaactactcagttctagcattttagagcaaaaccagctgcagacattatgtaaaggaattatgccatggctgtgtttcagtaaaactttatttacaaaagctgcagcagctgttgaggatgatgggtggccctgcctctgacccttgggtagccagcactgcctgctacctgctctgaggacttaaaattctcatttcattctcccaacaccatatgagacaagtactattactatccccattttgcagataaggaaaccgaggctcatgccaggcgtggcgactcacgcctataattccagcactttgagaggctgagatgggcggatcacttgagcccaggagttcgagaccagcctgggtctcatagtgagacccggtccccacaaaaaatacaaaaattacccagatgtggtggcgtgcacctgtagtcgagctactgcggcaggctgaggtgggaggatcattagagacctcccagcaagtcgaggctgcagtgagctgagactgcaccactccagcctggctaacacagtgagaccctgtctcaaaagaaggaaaggaaggaaagaaggaaaggaaaaaggaaaggaagaaaagaaggaaaccgaggctcagagaggacggaaatgagtcctccgaggtcacacaggtaggaaatgccagagctgaaactggaccggggcgcgctggactccaaagcctggcttcgggactccgctgtgcttgctcccgcagctctgctgaggacacgcccccctcccaggagccagacctcctccagcggggaagaggccccagaatggaaataggattgggagggggacctgccaagctagaaagatagccctgggtggtggccgagaaaaatcaagcccaacctcttttggcttcagggtgttgcagccccagcccctgtgggcccccttggggcctgcggaccgcgacagttcccaggcagctcagctgcgccccctcccggctgggcctggtggggctgatccatgacgttgacttggagtccagccaagcagtgtttcttgtggtaaaagaaacagacctccccctggatgattggggatgggatggccaggctgagacccacaatctcaggagccttcagcggacagctcctgacaagtccagtttgtcacctgcgaccaagggtgacattcctgatgtttaagcaatggcacagcagcaaatggaggctgggtgctggagcagggtcttgaagaccctgtcccctcccaccatgtgtcaccacccctgctggggctggcattaaccctttagctactggattgtgggcaggtctaggaggtccctggggaggcatcaggaagagaggaggaatgctcgggtggcttagggcagccctgggtaaccagcactctgcaggcatgagagacagtgcagagaccctgctgggccccagggcagagaagggaggcacagagtcatgcagttcccaaacctttggtggcagacaggacagcctcttctactccgtgtccctcgctgcctctctctggcctggcacttagaactgatgccgttcagacccggctggtgtgtgcagggagaggaagccagatgctcccagacactggggactgtcctgggcctccgtccccaaggtgtggctggaggaagcagagtctactcccgctaagtctgtccgctcactgctggccaaagctgccctgcgtctcctccccaccgccagccagagggaacctgcaatttcacctcatttagaggtaaaacatctaaatttaacgttatgggcttttggggctgggtggcttttatgcctgagtccctcacttagggctcctttttatccactcaaatgccagctagggcttagtttgtttataggagtttccaaaatagctcctttggtttcgcatgaaaggaaatggcaaaatagcccaggaagaggaatgtgagtttacacagaagacagacaggcgcccgaggaggcttctctgggaaccagttcgcctgtaccagagggggcccgagaaagtgtggagtccaacagtccaactcgctcattttaccgatgtcaagactaagcccaggatggtcacacaacttgcctggaccacccaaaggcgactggaagagccagaagaacccaaactactcctccctgccaaagcacaggcctcagctggagcccccctccagcctttgccctggctgtgtcctctgcctggcacacgcctcccttcccccaggtcttccctatcactctctcccagcttgcaggcctcacaaccaaggccacctcctcagagaggtcctccctgacccccttggctaacgtggacttgcccctcacccgtatccttcaaataactcatggttctgattgtcttattcatcagttaatcaagtatgcttctcaagaatcttcgctccagggagcagggggtttttctgtctttttaaaaaaaagtttttggggccaggcacactcctataattatgggctcacgcctgtaatcccagcactttgggaggctgagtctggtggatcacctgaggtcaggagttcaagatcagcctggccaacatggtgaaaccccatctgtactaaaaatacaaaaattagccaggcgtagtggcgggctcctgtaatcccagctactcaggaggctgaagcgggagaattgcttgaacccaggaagcggaggttgcagttagctgagatcacaccgttgcactccagcctgggtgataaagcaagacttcgtctcaaaaaaaaatttttttaaataaataaatacataaattattattattattatttttatagagatgggtcttgttatgtcacccaggctggtctcaaactcctggcctcaagcgatccacatggtgtgagccaccatgcccagcctgctggtttttaaagagcatatttaaatgaaaagagacaaatttaaaggacccttggtttaaatagagcaggttggaaccagcttcagggcagcccatggtcctggctctgccatcctccagaaccacctggagccaggaggggacacccaaggtgtctctgcagaggacagcggcctgacggatagacacacaatgagtgccctgatttgtgatttaagagaagaacaagcagctccttgggaagccccagtgtcccctgcgctccactgtcccaggactgcaggcaaagggacgcctcctgaccgcagaatagtcaacagcaggcacgggagtgaggaccgggatccagggaggccgcttccctctgtctatcagtctgcagccctgggtcccagctcactccattggggttttcccagataaagatgactcatgaatttctttgaattatccagagggcattttaattcaaatggccccatcactgcctcgtcaccactcccaccagccatgccaggggtcagccaggggtcaccttgaagacaaagcctctctttgggaaagaagcctttgaggccactgtggggtggctgtgtgtcggggcgccaggtgggaaggcagctggggcctgcccaggctagggaagagagcgtgggggtgtgggggatgaaggaagataaagatggggtagcgggagggagcgggggaagctgggcctccaagaagcacaggctgacttgggaatcccatctcaaacgtgcctcaccctggtctccagctgtaggagcagtgataaggatgaggacaggcaggagggactgagatgagatgagagcatttggagcctggagagagacccctgacactgagggagtgaggtgacctggtggtggctattccaggccaagcacctttgttcaactgtcaaaaactagaaacaggccgggcgcagtggctcatgcctataatcccagcactttgggaggccaaggtgggtggataacttgaggtcaggagtttgaaaccagcctggtcaacatggtgaaaccccatctctactaaaaacacagaaattagccaggtgtcgtggtgcatgcctgtaatcccagctactcgggaagctgaggcaggagaattgcttgaacccaggtggcagaggttgcagtgagccaagattatgccactgcactctagcctgggtgacagagcgagactccaactcaaaaaaaaaaaacctgaaaacagcaataatgccagtggtacccaacacggctacaggacttgtgcagtgccaggcattgctcaaagaattcactcattgaattcctggtacccaggaagtctggcctcaagcctgagctctgcccccgctgagcagaacccctctttctaaaccccggacactgggctggacacacagcctctcactcacccccacagctccccgggggcagggcactgttaccattgtacagaccaggaggctgaggctcgagatggagccacctgaagtggcaagttggtagcattgtacctccaatgactcaccaaaacgcctgcataaaaatccaggtgcagtggcactcacctgtagtcccagctacctgggaggctgaggcaggaggagcacttgagcccaggaagtttgaggccagcttgggcaacaccatgagccaaaaataaataaatacaatacaggtaaagtgcttgtgtataggcagtgtggtgcaggtgtgtgtacgcctgacctaggtcccaggagtgactaagggacacgcagagtggggctctccaatcagaagccctcactctggaattggttatgggagggtccctggacctcagcatgtaatgctttgctgtggaggctgtcctgtgtgttcagcagtgtccccacaccaggagcacagcctgtgacagcctggcacatctccagacactgccacacgtccctgtgctaaaggcatctcttcggacctgggctggagggttcattaacccgtatggtggcttaggcataattttccatgggcgaaatgagtagtattgaagacactatggtatttggttggctacagtattgctcgggcaccttcccctcacacgaacaggtgtgggactctggcagaccacacagcctgacacctacggagcggccctgggtctgcggctcccacagggcctctgccactccagccgtgacacacacacatgctgtcaccagcctaggatgtgcacaaagcctgtaggtctgagaccaaggacatgagcttggaggagctggctggattcctcagacctctggggcccgtttgccagagcagagccgagacctgcctgagacctgccttcattgcaaccctggccctgtggcacggctgcaagggaggagagaccgggtgaagggctgcttcccctttccatccaaaaacacacaaacaaaagacgcctgagcttggtgaacacacgcactggtcaggcttagctccatgcggggaggatgtaaattcaaacccaggtgggctgaactccaaagcactcttcggccaaccactggtcactggaatgaactgcccccaaccctctgtcatctcggggacacagaccctgcccccctccgcagggctggacagcagagcagcttccctctacaaaacggtcaaaaaggcaaagaaagacttccacaccctgccgctgcctgggagaaccctgagcttcctttctgcagtgacctctccattagacgcacaggcccacgcatgcgcccacgaacacatgtgaattacttctaggatcagaaggcaaaaaaatgttctttaggtcaaagaaaatgtgttattatataagagtaatgtattcattgttatagcaagttgtaatatgcacttcttttttttttttttttttgagacggagctttgctctttttgcccaggctggagtgcaatggcgcaatctcggctcaccgcaacatctgcctcctgggttcaagcaattctcctgcctcagcctcctgagtagctgggattacaggcatgcaccaccacgcctgggtaattttttgtatttttagtagagacagattttctccatgttggtcaggctggtctcaaactcctgacctcaggtaatccgcctgcctcggcctcccaaagtgctgggattacaggcgtgagccaccacgtccggctcacttctttttttttctgagagagagacagggctcactctatcacccaggctggagtgcagtggtgggatcacagctcactgcagccttgacctcctgggttcaagcgatcctcccatctccgcctcctgagtagctgggactacaggtatgtgccactgcacccggctaatttttttaaaatttctttagagacagggtctctctatgtggcccaggccagggtgcagtggtgtgatcatagctcactgcagcctccaactcctggactgaagcagtcctcccacctcagcctcatgagtagctgggactacaggtgtgagccccacacctggtcctatttcttattggaagggccactgcaggccaagatgctcggtgcccagggaagtcatagcacggccctgcccttgaccccttccagccatcctgggaatctgtccccagccacctccaggccacaggctccttccccatctcttccccacccaggagctgtgttacacagatcactttagcgtttcccacgctaaaccactgaaactgagggttttatctcccactctccttgctcccagttccgcatggccactggcctggctgagacagagccgctggaagtgcccggcaggacctctcacttgaccttcagcctcttacttaaccctcccaatgcagggcggtagcctccactgggtcctgttcagcccctactcctagaaatggtctggggggtaagggtggggccccctgcagagcccttggatgtgtgtttgcgccatggcagtagtacacccacccccttctgcttccgcagaacctggccggctcctccccatcccagggggagaggctcctcctgctcccacttccctcctttacatttggctactactcttaggggtggggctttgtttactttgcattttcctgattcctaatgagattaagcacatttccttaggtttaccggcttcccaatctcctcttctgggaattttcagtgcctattcctttgtccagttatctgccttcttcttcttgattgctgggagcggctgataaatcctagatgaccatcctttctcagttttctcccagcccctcaccttttaatcttaaattgttctctgtgggtgtgtgtgtgtgtgtgtgtgtgtgtgtgtgtgagagagagagaaacagggagagagatacaagcttcaaatacttatgtggccaaatccgtcacaggttttccttctgtgttttacaatttggaaactgctttctggtctctaagattaagttgctaatctgttaaccactggtgtttaattccctgggggagaagcttgtcttcccagccaggctgcaaagtcccccagggtatgtctccatctcccccctccccccatgaggccttagtcaagagattccactgctcctcagaaataccgtgaatttgtcccctccttcctgcctccacccctgctcgccaggaccaatctctgcctccctctcaccctctgccccacatgattaccacagtgatttaaaaaaaaaaaatccatcagaggccaggtgctgtggctcacgcctgtaaccccagcactttgggaggtcaaagcgggcagatcacctgaggtcaggagttcgagaccagcctgaccaacatggagaaaccctgtctctactaaaaatacaaaattagccgggcgtagtggcacatgcctgtaatcccagctactcaggaggctgaggcaggagaattgcttgaacccgggaggcagaggttgcggtgagccgagattgcaccattgcactccagactgggcaacaagaccgaaactccatctcaaaaaaaaaacccaaaaagaatagaaaaatgtccatcagggctggatgcagtggctcaagcctgtaatctcagcacttttttttttttttttgagatggagtctcgctctgtcgcccaggcggaagtgcagtggctggatcttggctcactgcaacctttgcctccaggctccagtgattctcccgcctcagcctcccaagtagctaggactacaagtgtgcaccactaggccaggctaatttttgtgtgtgttttttttttttttttagtagagttggggtttcaccatcttggccaggctggtctcaaactcctgacctcaagtgatcctcccgccttggcctcccaaagtgtggggattacagctgtgagccaccatgtctggccaaatcccaccactttgggaggccgaggtgggaagaccgcttaaagccaggagtttgagaccagcctgggcaacacagagagacccatctctacaagaagtgaaaaaaaaagttgggcacatgttctcaggaccccctgaggctatgtcttgggtcatggtcactcataaataaattgttttaattaaaaataaatgttgaaaaattagctgagcatggtggtatgtacttgtagtcccagctaaggcaggaggatttctttctttctttctttttttttttttttttgagatggagcctcactctgtcgcccaggctggagtgcagtggtgcaatctcggctcactgcaagctccgcctcccgggttcacgccattctgccattctcctgcctcagcctcccaagtagctgggactacaggcgcccgccactgtgcccggctaattttttgtatttttagtagagatggggtttcaccgtgttagccaggatggtctcgatctcctgacctcgtgatccgcccacctcagcctcccaaggtgctgggattacaggcgtgagccaccgcacccagctgggaggctaaggcaggaggatttcttgagcccaggagttcaaggctgcagtgagccaggattgtgccactgcactccagcctgggcaacagaatgagaccacatctctaaaaaaatttaaaaataaataaaaaataaaaatgtcccttagtttgtcactatattgcccaggctggtttggaactcctggcctcatgtaatcctcccagctcagcctcccaaagcgccgggattacaggcataagccactgcacctgaccccaaccgaaaattcttaaggcacatttttgacactaaaaacagtattttataactgctaaaatagatatgttaattctagtcttttcttgtgcacagaaacaaattaccactttagtttctcaaggagcacatgtatacatgttaaatgcattaatttgtttaatataaacatgaaatactttttataacctggattggtacatatttcttttcttttcttttttttctttgaggcaagatctggccctatcaccaggctggagtgcagtggtgcaatcttggctcactgctacctctgcctcccgggctcaagcaatcctcccacctcagtctcctgagtagctgggactacaggcatgtgccaccatgaccggctaatttctgttttgtttttttttgtttgcttttttttttttttttttttttttttgtagagacggagtttcaccatgttgcccagactattctcaaactcctgggctcaagcgatcctcaacctcaacctcccgaagtgttgggattccaggtgtgagccactgcacccagcccttttatttattttttattttttattttttttttttgagacggagtttcgctcttgtcacccagactggagtgcaggggcgcaatcttggctcattgcaacctccacctccgtggttcaagcagttccccggcctcagcctcccgagtagctgagattacaagcacacgccaccaagcccagctaatttttttgtatttttagtagagacagggtttcatcatgttgaccagcctggtctcaaactcctgacctcaggcaatccgcctgcctcagccttccaaagtgctgggattacaggcatgagccactgcgcctggcccccatttcttattatacagtagtttacaaaaaaatcccagcagccagctccagagaggccttgttctgtggtgtctaaggatggagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagcctaagggcactgggaaccctgtgggcatgcgcagttcaagcccatccccgctccctccagctgctgtccatccctgccacacctgaccatttgcctaacctagatccttcctgtcttgcatttcctcaagcatccggagcccaggactgctgagtcaaccctctggaatgcccacaactccccacaggccagccggccttgggactcccgcacagccacgtgagccggtggagccgggtctgtttgctagtggaggctgttaacagcacgggaagtggtcaagggttcaacaagagatgagccatctggtcctccagaggtaaacaatttacaagagacacatcaagccggcctgctgttctggtttttcttttgacagtgaaatatgcagtttctttttcatcctggtgcctattggagagggagactgttccaggcactctgaccccagctaaagcgcctccctggggcaggatctatgcagggaggcagaaaagtcagattttttttcacatcttctttgttccattcccaggactgagcaacttcatgtatttatgtatttatttatttatttatagacaggttctcactatgtcgcccaggctggagtgcagtggtgcggtcacagctcactgcaacctcaatgtcctaggctccagtgatcctcctgcctcagcctcctgagtagccgggaccataggtgtgtaccaccatgccaggggaatttttgtatctttggttagagaaagggttttgctgtgatgttgcccagtctggtctcaaactcctgagctcaagcgattcaccctcctgggcctcccaaagtgctgggattacaggtgggagccactgtgcgtggcccaggactgagcaactttaagtcagatggttaacctacatcatgaggaaagtggatttcctcccaaaggaacagacttattttctagaacccaaagccttgaatttcaagaacctttagccttaaatccatttcctgttggaagcagaccccctcctggtctccccaggtattgcaaccctgctctaccagccactataaatgcccacacaaaaggaacaggggctccattcctgatgctcagagtggagtcactagattctcaagcatatgagatatgtatgtggcctaacagcctgaaataaacagcttgtgctgggattgtaattctagagtttccaaaagtgttgcaaaatattccaggcagacactaaagtttgtgtactacaagctgtttattaattaatttcttatttgccaaacattcttgcttgggtctactgggagatgatttcgttgggaatgcatctccaattttgtaataaagatcaccagggaaagaaggcttgcttcataggggctcatattacaggaaatgtggctagcataggtagttcccataagaaaaaggacagtactaagttttgagctcatgtgaaaaagaaaagggggccgggcgtggtggctcacacctgtaatccgcactttcggaggccgaggcggacggatcacttgaggtcaggagttcaagaccagcttggccaacatggcaaaaccctgtctctattaaaaatacaaaaattagccaggcgtggtggcggacgcctgtaatcccagctacttgggaggctgaggcaggagaatcacttgaacccgggaggcggaggttgtagtgagccaggatcgcatcactgtactccagcctaggcgacaagagcgaaactccatctcaaaagaaaaaaaagaaaagtgacgtctggggaccaggattttgggactctttgcagacatgccaataacctgtgagatacacacccacagactgacacagaggtgagcagaggccttggagtcaacagaagttcaagtctagcctttgcctcattctcttttttttttttttttttttttgagatggagtcttgctctgtcacccaggctggagtgcagtggcgcaatctcggctcactgcaagctccgcctcccgggttcacgccattctcctgcctcagcctcccaagtagctgggactacaggcgcccgctaccatgcccggctaattttttgtatttttagtagagacagggtttcaccgtgttagccaggatggtctcgatctcctgacctcgtgatccacccgcctcggcctcccaaagtgctgggattacaggcatgagccaccgcacccggccacctcattctcactatgtgaccttggacaagtcacttatcctctttgagcctccagttcctcatctatacattggaagccactgaaattatcttacagttactttcagttgcgaggacttgctctttttctcttcattaaaaggaaaacacaaaatataatttatagcttatcctaccactttgtgctgctaaggttaaaatccagggtagtggccaggcgcggtggctcatgcctacaatcctagcattttgggaggccaagacgggtggatcacctgaggtcaggagttttagaccagcctcaccaacatggagaaaccccatctctactaaaaatataaaaattagctgggtgtgttggtgggcacctgtaatcccagctactcgggagactgaggcaggagaattgcctgaacctgggaggcagaggttgcagtgagctgagatcatgccactgcactccagcctgggtgacaatagcaacactccatctctaaaaaaaagaaagaaaaaaatccagggtactctatggtttcctggggctgctgtaaaaaaaaaaaaaaatactacaaactgggtggcttcaaacaagggaaacttattgtcttgcagttctggaggttagaagtccaaatcaaggtgtcggcagggccatgctccctctaaagcagcggtccccaacctttttggcaccagggacaagttttgtggaagacaatttttccactgaccagggtgggggttgggtgggtggttttggggtgattcaagtgcattacattcattgtgcactttatttctactactacattgtaatatataatgaaataattatacaactcacattccataatgtggaatcagtgggagccctgagcttgttttcctgcaactagatggtcccatctgggggtgatggagacagtgacagatcatcaggcattagattctcataaggagcatgcagccgagatccctcgcatgcgtagttcacaatagggttcgtgctcctgtgagaattgaacgcctccactgatcagacaggaggtaacacaagcaatggggagtggttctaaatacagatgaagcttcgcttacctgcctgctgctaacctcctgctatgtggcccagttcctaacagaccatggacaagtacaagtccatggcccaggggttgggaacccttgctctaaaggatctaggaaagaatccttccttgcctcttcctagcttctggtgatggctaccaatccttggcatttctggtcttgtagctgcatgacgccaatctctgcttctgttgtcccatggtgcttcccagtgtctctgtcttcacagctcttcctcttcttataaggatatgacggtattgaattagaggcagggcacaatggctcacacctgtaatcccaacactttgggaggccaagatggacagatcacctgaggttaggagttggagaccagcctggccaacatggcgaaaccccgtctctactaaaaatacaaacattagccaggggtggtggtgggtacctgtaatcccagctactcgggaggctgaggcaggagaatcgctcaaacccaggaggcagagtttgtagtgggctgagatcatgccattgcactccaacctggctacagagcaagccatctcaaaaaaaagaaaagatgtaggcccctgggaaggatgcctggcacactcagaggtgggacaatggtgacagtcctgacactttccctctggagagcatggacccctggtcttggccatgcagccaggcctggcccagcctgcctgtcccccacccccacccacagggactgggcccttcctgcccaggaactattctgattctgcagccctcaggctttattgcttttcctgcttaatgaggtgaggttcgctcagcccagtggcaattcctgtaaaagccatttggatgacccaatggggtgagtttacagggaagcgctccctgagggctaggctggctggaagcagatactttgcccccttccaaggacggtaatgaggtttgaggcttccaatgggggcaggggatgatctgggcgccaaaagccctggcctggggtcaaaagatctgggctccagccccagccgggctaactaggcagtctcctgtctgagctgtactcccctcatgggtgaaatggggatacaggcacatactttatagcctgcagtctgtgtgtaacagagaaccataagctggtgggtcggggagtggggctgggggttatttctcatggttctggaagcgaggagttggagatcagggtgactgcatggtaaggttctggtgagggccctcttccaggttgcagactatggtcctctcatttcatccccacgtggagggaagaggcaagagaacactctggaagttataagagcactaatcccattaatcccattcaccaggcctccaccctcgagatctattcacctcccaaaggccccacctcctaatcacagcacgggggtttgggttcaacataggaatttttttttgagatggcatctcacacagtgttgccaggctgtagtgcagtggcgcaatctctgctcactgcaacctccacctcccgggctcaaacaatcctcccacctcagcctcctgagtagctgggaccacaggtgtgcaccaccacacctggctaactttttgtacttttagtagagacgagatttcaccgtgttgctcagattggtctcaaactcctgagcttaagtgatttgcccacgttggcctcccaaagtgttgggattacagatgtgagacaccacatccaacctcaacatatgaattttagagtgacccaaacattcagtccatcacagtctcctgcaggattacagatgtataatcagtctgtaatccacaaagttctaagcaaaggaaaagaagtaccaatatcactattgctattgttattatcagcacccaagaccttccccagtctcagtgagtggaatattaagatgatcccaaagacgctcgacttctctaacccgtaatactcacaggttccacccctttgattgtgggcagaacctgtgaatattatgatctgactgccatggttaccttatatgacaaaagggagattagcctgggtgggcctgacctaatcagagagccctcaaacaggactggctttttgttttttgttttttttttgagaccgagtctcgctctgtcacctagactggagtgcagtggcatgatctcagctcactgcaacctctgcctcccgggttcaagcagttctcctgcctcagcctcctgttggctcttactggccaaggagattcaaagtatgagagggattcagcgtgagagagattttccattgcaggctttggaggtgaaggtggccaatacaggaggcctctagaagctgaaagcagccccccagtgacagctaggaaggaaatggggacctcagtcctatggccacacggaactgaatgaccttggaagtggatttgtccccagatcctccagacaagaactcagccggaccaacatcttgcatttcagccttgcgatgagcagagaactcagccatgccagactctggaccaacacagctgtgagctcatacatggatattgttttaagctgctgggtctgggatcatttgttacacagcaatagaaaaccaatacatactctgtcaaggaagcctgagaatggaaggcccctactcaatctaccctcccactatagtctggtggttagagacaagggctctggagtcagatggaacggtgttcgaatcttggcaattccatccactggctgtggaacgttgtccacactcccttcctcacctcttatatcctcggtttcctcatctgtgaaatagcagtggaaataaaatgcatggaaatcatcagagcagggtatgcatcgtaaggacacatagtaatagctcaagaaacactgtatatgttaaacattagaaacgagctgagaactaacaccaatgcacctgtgttcttcaatgcactgcctacacaccagagaagagggggaggagcccagatctgctgctctgggagctacaggccaattagggaatcaggaacctgaacagaaaaccacaacttcagggaaagtagatggtacatgtgttatgttattgtggacatggcggggcaaagacaagaccttaggtctttgaactccccctcggagtctggcacaggcctgagtggagctccctcctcaagacttcctttgcactggcttccctgaggaagcatttgcatttagggttctgctgtggaacctctttctcttgatctacatgaagcctgaggccaaggccttacacctgtaagggaggaggtggccctgggcccaggaaaagggtgggtccagtctcccagttctgtccctggcatgtactctccccaggcctatcccacccccaagtcctcccaggctccaaaccctgaggccccaccgactgtcactcaagaaatcaccgaggctgggcatggtggttcatgcctataatcccagcactttgggaggctggggcaggtgaatcacttgaggtcaggaattcaagaccagcctggccaacatggtgaaaccccatctctactgaaaatacacaaattagccaggcgtggtggcgggcgcctgtaatcccagctacttgggaggctgagacaatagaatcgcttgagcctgggaggtggaggttgcagtgagccgagattgcaacacggcactccagcctgggcgacagagagagattctgtctcaaaaaaaaaaaaaaaaaaaaaaagaaaagaaaagaaaagaaagaaagaaaagaaaagaaaaaagaaatcaccaagccctctctatacccataagcacagccttgaccgaagtcctgacggctgagcatgcagctcaaatccctggggagataccactgcacatacacgagggcggtcgtcatccaaaagacagaccacagcaagcgctggagaggatgtggggcaactgaaaccctggtacgctactggtgacatgtaagagggcgcagctgctttggaaaacagcttggcagttcctcaaatggttaagtatgaaattaagcaaatggttaaatgtaaatacgacccagcagttccactcctaagtatacatccaagaggaatgttaacatatgtccacgcaaaacccatacacagacattcagagcagcattactcatagtagccaagaagtaaaaacagctcaaatatttatcagctgatgagtgggtaaacaaaatgtgggacagccatacaaagggacactatagggccatataaaagggaccaagccctgatgcatgctgtgagacagatgaaccttgaaaacggtatgctaagtgaaagaagccagaaccagcaggccacagaaggtatggctccacggacaagcaagtccagagcaggcaaatccagagagacagaaagtggatcagtcattgccagaagttgagggaggggagaatgggagtcattactaataggtatggggtttctttctggggtaaaactgctctggatttagatagtggtgatggttgcacagctttgtgaatatgccaaaaaaaagaaaaaaacactaaattgtatacttttttttttttttgagacagcctccctctattacccaggctggagtgcagtggcacaatcttggctcactgcaacctctgcctcctgggttcaagcgattttcctgcctcagcctcctgagattacaggcgtatgccaccacacttggctaatttttttttttttcgagacagggtctccctctgttgtccatgctagagtgcagtggtgccatcttggctcactgaaacctctgcctcccgggtttgagcaattctcccacctcagcctcccaagtaggtgggactacaggcatgcaccacccacttggctactttttgaatttttttgtagagacagggttttgccatgttgcccaggctggtctcaaactcctggagtcaaacaatccatccgcctcggatatttctcactggcataatcagtgctgaaagatcattgaaaaggggcttgcatgatccagaggtcactgttatttaatgcgctctcctcatctcctgcaggttgtgacttcaatataccctctcatgagacctttcctggccccttatctgtaagtgtgaccaccgggaccccgtctcccaattccctcttcctgctttatttttctctttagcatttaataccatctgacattccaaacattaccttgtccttgtctggtgtttgtcaccccaactagaagtgctagggggcaagtactaggaagcagggttttttctttttctttcctttttttttgagatgaaatttctctcttgtctcccaggctggagtacagtggcgcaatatcggttcactgcaacctccacctcccgggttcaagtgattctcctgcctcagcctcccaagtagttggcactacaggtgcctgccatcatgcccaactaatttttgtatttttagtagagatggggtttcactccgttggccaggctggtctcgaactcctgacctcatgactctcccaggaggcagagttttttttttttttttttttttttttgagatggaggcttgctctgtcacccaggctggagtgcagtggcgcaatctcggctcactgcaagctcccaggaggcagagtttttgtctgcgtggttcactgctaagtccccagcactaagaggacaggacctaacacataggaggcactcagcaaacatccatgaacgaatgaatgaatctgtatctccagtggctttgtcctctcttatatcagctttgttccacatcttacacttaggaggtgattcaattaaacattgctttttgtgtgtgtttggtggggtttttttgtttttttgtctttttgttttttgagacagcatctcaatcttttgcctaggctggtgtacagtggtgccatcaccactcactgcagcctcaacttcccaaactcaggtgattctcccacctcaactccccgagtagctgggactacaggcacgcaccaccacaccagctactttttgtatttttagtagagatggggtttcaccatgttgccatggctggtctcaaactcctggcctcaagccatccatttgcccaactaggccccccagagtgctgggattatgggcgtgagccactgcacccggccaaccattgttgagtgagcaagtaaatgaactcatcaacgaatttctccctgggtagcgaagctcccgctttttgaggtaacccagacttttcatttgtatgtttcctgagtccctgactgtacattcttcctgcatattgtctccaggactaagagaatggagccttttgccaagaagaggttgcgttctcaggcctccagtttagattaaatagtggttttacaaggggaaacaaagtgacaaacccccagaagttgtggggagctgagacggggtgggaatagggttccccagggacaaactccttcttgtccccctgcccagcgccccagggcacactgcccagtgggtgaaagcagccagacacacgggctcactgcagttaccaagcaatcctaagtgtatcaagatgggcgcgctgacgacagctgcaccgagtgaatctggaatgaattggggggttgttaagatcgccgacttaagcctcttctcacaggaaaaatatttatttcactgagctctgctttttggaaagctgcgcctgtaacagtctgcatcgatctagcagagttttggctactgctgggttttgtctccctcctgtctcggttagcgtgggctgtgtgtgtgtgtgtgtgtgtgtgtgtgtgtgtgtccacagcacaccctcccattattaagcaatcagccaaaagactcagccaggacactctgctcttctttaaccagaaaaaagatgaacacgaactgagttcgtggcatgaggcacgagaccttcatgttttatcttcaaagatgcctgcttgaaactagcaattgtttctttccctttttatctagtaaattgctccctctacctcctcccagtttgggaaaaaaatacaagtatgaagaagaaagtaaaaatcactcctatggttaggttaggcttgactgcagaattgtttcctttttttttctttttttctttttttttgagacggagtctcactgttgcccaggctggagtgcagtagcatgcgatcttggctcactgcaacctccacctcctgggttcaagcgattctcctgcctcagcctcctgagcagctgggactacaggcccgcatcaccatgcccggctaatttttgtatttttagtagagacggggtttcaccatgttggccaggctgtcctttccttttctactctttggagtcgaggggcctgggtttgaatcctagctctgccacttgctggctgtgtaaccctgagaatcatgtcaccacttggaacctctgtttcctcatctgtcaaatggtgtaataatagtgcctgcctctttgattgttgggaggagtaaacaagagaaagtatatatagagcttagtgaaggttcagcaacaataaatgcaaatggtacctattttataggagaaatatatacaattttttatcttctttttcataaaacagtatagcgtatacagtttcctgtttcactgcctcattttagaggcagagtcttgctgtgttgcccaggctggcctcaaactcctgtctgtgctcaaatgatcctcctgcctcagcctcctgagtagctgggattacaggcacccaccaccatgcccggctaatttttgtacttttagtagagacggggtttcatcgtgttggtcaggctggtctcgaactcctgacctcatgatccgcccacctcggcctcccaaagtgctgggattacaggcgtgagctaccgtgcccggccaactcacaagcatttctaatgactgcaaaatagtccattgggggcccatccctacattagtttttaaaccgtttcctatggatggaaatagaagttgcttccgaaatattataaagattgctgtgataaacacctccagactcaaatcttggtctatgtttgaggctctgtctttaggatgaattctcagaagttaaattgttggtcaaatagtatgatcacttccaagagccttgatataccatacttagcactgcaagttgctttcgagaaagattacctacagatgtgtatgagagaaccctgtggccaagcgaggtggctcatgcctatagtcccaacactttgggaggccaaggtgggaggatcacttgagcccaggagttcaagaccagccttggcaacatagtgagaccccatctctccacacacacaaagaaagagagaggctgggcatggtggttcacacctataatcctagcactttaggagacctaggcaggtggatcacttgaggtcaggagttcgagaccagcctggccaacatggcaaaacctcatctctactacagatacaaaaattagccaggcctggtggcatgtgcctgtaatcccagctacttgggaggctgaggcaggagaattgcttgaacctgggaggtggaggttgcagtgagctgagatcacaccactgcactttagtctgggcaacagagtgagactcttctcagaaaaaaaaagagagaaagagagagagaacccatcttaccacatcccagctgcattgaggattattaccttttagttgttgttaatttgacaggcaaaatgacatctcattcttaaatctgcattaaaaaaatttcacccagtatttttctaatactagttttattggctacaatgtgttgagtgtttactacatgccaagcatagggtaaatgtcttttacttttttttttttttttttttttgagagacagggtcttgcctgttgcccaggctggagtgcagtgatgcgatcatacctcactacagccttgaactcctgggctcaagggatctttctgcatcagcctctctcttaagtagctaggactccaggtgcaccaccatgcctggctaatttttttttatttttatttttttgtagtaacagggcctcggtatattgcccaggctggtctcaaactcctgggctcaagtgctcctcctacctcggcctcccaaagtactgggattacaggtgtgagacaccatacccagcctccataaaatgttttaatcaaacttctgggtatgtacccaaaagaagcgaaagcagggactctaacaaatatttgtacatctatattcatagccacattattcatcatagcaaaaaggtgcaagagacccaaatgtccattgacagatgaatggataaacaaaatgtggtgtgtatatatgcaatgagatattattcagccttaaaaaggaagaaaatgttgacccatacgacaacatggatgaaccatgaagacattatgataagaaaatatgcccatcacacaaggacaagtgatgtatgatccttttatatgaggttcctagaatactcaaattcagagacagaaatcagaatggttggactgagcgaggtggctcacacctgtaatcccagcactttgggagaccacggtgggaggatcgctcgagcccaggagtttgagaccagcctggacaacagagtgagatcctatctctacaaaataaaactttttaaaaattagccaggtgtggtggtatatgcctactactcaggaggctgaggtgggaggattgattagactcaagagatcaaggttacagtgagctgtaattgccccactgcactgcagcctgggaaacagagcgagattctgtctcaaaaaaaaaaaattataatcaatctttacatgttattttataagatgttattattaccctccagccttctttaaaagatgatgaaactaaggctcagagagatgaaacacgttcctagagtcacatagcttataaatggtgaagacaggtttagatgccaggtcttactctccaaggctacgttatcctgcaaattctggtggacctgggaggtaaaggggaaatacaatcaagctctaggtggcagatggagttagcaagtacccagtgccaaacggaactgttggccctgagagctcagagttcagttctaaatttattctctctgaccttattgtggattctaaatttggccaaacaagttcttccagaccgattagtgacgtggatacattgttttgaagataaaacccttttcctggtatgaaagaaaaaaaataataatgcagcatttgcttgcagaagccaccctgccgctggttaacagccatctgaaaatgattctgggttttccacctgatggtggacacatgtgcttgttggccgatttcttggggacagtgattaaaaccatttcctgaaccgaagtctgaatttctcctcctgaatgaaccagaaacaaaacatcaggaaatatccaggcatgaaaattctaaccagggccgggtgcggtggctcacaactgtaatcccagcactttgggaggctgaagggggtggatcacctgaggtcaggagtttgagaccagactggttaacatgacaaaaccccatctctactaaaaatacaaaaattagccaggcgtggtggcaggcacctgtaatcccagctactcgggaggctgaggcggaagaatcacttgaaccctggaagcagaggttgcagtgagccgagatcacaccattgcactccagcctaggtgacaagagcgaaactccgtctcaaaaaaaaaaaaaaaaaaaaattctaaccagaaccaaacttaaaattctcccaaaattacaaattaagaccaaaataggcctctttgggtggtttccaggccagggaggagttatggggtcctcggataatcaccagctgagtcctgacttctctgggaaggtattggggtgactgacctgtttgtgaccccttctcagacaccctatctccaatcaggtggaggaggcacgtgacccacatggtctggccactgatgactgaacaagctatggacaccggaccccggagagaccattcactcactggccacgaacatgagttcagatacatgccccaaaaggatgagcctgggtactggattccctccctcagaaacgtgaatcaagagacacaggatgttcctgttggtccagatacttgagctaaaaggtgatggatacctggatgtggggtggtcattctggggagtacgtccatatagaaagaggagcaggtgctgtgggattctggatcccagtgatagagctaagtggctggatcaagcttcacctgaaacccactctacttgtcttagtccattttgtgttgctataaaagaatacctgcaactgggtaatgtataaagaaaagagacttatttcattttatagctctgcagtctgagacatttaaagggatggccttgacttctggcaagggcttgcacgttgcatcaccacacgcaggaaaagggaaaacagaagggagactgcaaaaaaggggaaaacctgaaggtcatcatagctttataataacccactctcacagcaatgagttagatggagaaccaattcagtctcacgagagtgacagcaagaactcactcactggtgagagggtagcacttccaagccattcatgagggattcacctccatagcccaacacctcccactaggccccgcctcccaacactgccacagtggagatcaaattgcaacatgagttttggtggagacaaacaccccctatccaaatcacagcactacccccgaactttccattacacgaaccaaagaatcttcctttaaattagtgtcattgggttttctgggatttacctttttttttttttttttttttttgagacagggtcttgctctgtcacccaggctagagtgtagtggcacaaacacagctcactgtaggctcgacctcctgggctcaagggatcctcccacctcagcaccccccacctatgccctcaaagtagctggaactacaggaaccaccacacctggctaattaaaaaaaaaaaattttgtagaggccgggtgcggtgtctcatgcctgtaatcccagcactttgggaggccgaggtgagtggatcacctgaggtcaggagtacaagaccaacctgaccaacatggtgaaaacctgtctctattaaaaatacaaaaattagctgggcgtggtggcacatgcctgtaatcccagctactcgggaggctgaggcaggagaatcgcttgaacgcgggaggcggaggttgcagtgagccaaaatcacgccactgcactccagcctgggcaacagaacgagactgtcttaaaaaataaaaaaaaaaattgtagggacacagtttcactatgttgcccaggccagtcttcaactcctgggcttaagcaatcctcctgtctttacctcccaaagtgctgggattacaggcatgagccaccacacccagcctaacatgtttttaataaccaaaagaaaataaacatctccatagccttgtgacacatccttttttaacctgaaattggtagagtaggtttctgattcatagaacccaaacaaacattcctccctaaagcaggcagaggctctttgggagagtttactttcaaaacagtgtccctgcaagtcccaagtgacaagttcccctttcctggtctgaagcattctgaggagaggcaaagaggttaaggcttagctgcaggaacacgctgtccccacgacaaccccttctcagcctcggaactgctgttatcagagttgtgttgtctcttgaaggtccggacaaagggtgaagccaggactcctgagtctaaagggcaggtcggggcctgggagagaaggggaagctggcctggggcagagatatgttttccatttcccctggggtcccgcgcaggacagctgctgtccatagccagttcagccaaccgtgggaggaatcacattcactcgacaggcaggcagtggcggcactgggatttgaacatggggctgatgggctccaggcgtggcacctgtgccactacagtgcggggaagctctgactgctgcagcctccgttgtcgccacatctgccctcgaatttcccttccagctggttctgcaatcagcagcccctccagacatccctgggaggctccaaggagctgactcctgatgaggaaaaggatcagccgcagactcactcctcctccagccacttccagacccacgggaggcgtgggtgtgacccagactacctgggagcatctgcttttgtctttatccagggcaggaccctctgaaggaggagccctcagagaagaagggaaaagccaaaaggaattaaaagccaatttccaaatggaaataaataagcagtcataattggccacattggtgaaattgggcactaagggccaggcaatgggctgtgggataatgtcacttgaggcttacggccacgctcagaggaaggtgctgaggtccagggaggttcaggcaggtgacatgactcacccagagccactggctggagagtggcagggctagcttggagcccaggtggtggacttcataggtgcagccgtgactgctgtcatccctcccatggggagttgttgcagagagtgagacacagcgccctaagctatttctccatctggtgtgcctggatgcctctgcccacccaggaccctcctctcgggtggcccaccactgcccttccatcacagttcataccttctctcgtggacccacaggggtgtccactggaccaggaccccagggaggatcccagtcctggccccaccactctctggctggtgacacgggggaagtcaattctttccaagcctcagctttctcacctgtacaatgggagtttgtgctagacaagaagttttcaggacggacacagtggctcacgcctgtaatcccaacacttggggaggccgaggcgggtgggtcacttgaggtcaggagttcgagaccagcctggccaacatggtgaaacctcatctctactaaaaatataaaaattagccagattgtcatagcgcatgcctgtagtcccagttactcgggagactgaagccaggagaatcacttgaaccggggaggtggaggttgcagtgggccaagatctcaccactgtactccagcccgggtgacagagagagactgtctcaaaaaaaaaaaaaaaaaaaaaagttttcaaactgctgactgcacctgtttgtaggccctgagctcaactgagtgagtcacacaggtattcactgacgtgattctgcctccaaggccacattttctccagtgcacctctgtccttcagcaagtgacctgaggctgggactgccacatgctgcctcccatcagcaccttacccagacctactgctggctacaacgtgcttaatgattgtcaggtggctcacataccctgttctgttcggcttcacagtgtctgccagcccgtggagtatggcacagtggctactagccagggtcaggcagtgcgactccacctctccaagcgccccagtgcagcgtctgatcatagggaataactctacctgcttcacaggactattctgtgaatactaattaggataacatatgtgaaggtcttggcgttgtgagcacatgagcccaaggtcagctccctaaaatgatgaagttcatatcacaagaggcccctagaggtcaggacagcctttcggtacctttctatggcaaacaagcggctggttctctgccacctattttctccccttcattgggcaagactgagctggcagaataatggccacatcagtatttactctctactttctggcttccctagattggtgccagccatttgtccccccatccaagacaaccctgatccccatccccagaaggaaaacacctcacctctctcacaatttgagaatggctgtcaactcgagcacattattagatttaattgtatctaatacttgaatacctaatatattactttctctctctctctcttttttttttttttttttgagatggagtttcattcttattccccaggctggagtgcaatggcgtggtctcggctcactgcaaactccgcctcccggcttcaagcgattctcctgcctcagcctcccgacttgctgggattacaggctctcgccactacacctggctaatttctgtatttttagtagagacggggtttcaccatgttggtcaggctggtctcgaactcctggcttcaggtgatccacctgcctcgacctcccaaagtgctggcactataggcgtgagccaccgcacctggccccaatatattactttcaaggacaaaaactgcaattacttttgcaccaacctaatatttaaggtaggacaccgtgaagcccagtgagatctctgtggtggacaaacagcgtggctgctaggctgtgagccctcccgcctgtctgctctccatgctgtgcgccactcctgagagctgggtcagcagtcgcactgttggctttgctctgacctcgagtctatttcttttccatgtgtgtgtgcagccgctgcctggagtggaaatctccactgagggacagaccttctttcaaggctcacatcaggcaggatcccacgggaaagggggctggctgagtcaggagggttctctgcctgagttcccgtgtgacattgggcaaatcactcaacgctcagagctgcgcatttttatctccatctgcttggagcaggaattgcaaagagtttcagctcaggttccaacgccaaggtgggagatattggttgctttgggtatagtgttgagatagattctgaggctgtgtatgggctcactaggaaagggtgctgtgtctgccatgaagtgggaaatcggtgggggaagaaaaaagaaacccggctgggcacggtggctcacacctgtaatcccaacactttgggaggccggggcaggaggatcacctgaggttaggagtttgagaccagcctggccaacatggcaaaaacttgtctctactaaaaatacaaaaattagccaggcatggtggcgcatgcctgtaatcccagctacctgggaggctgaaacaggagaatcacttgaacccaggaggcagagattgcagtgagccaagatcatgccactgcattccagcctgggtgacagagcgagaccctgtctcaaaaataaaacccaaaaaacaaaacaaaacaaacaaaaaaaccccatggtgctggccgggtgcggtggctcacgcctgtaatcccagccttttgggaggctgaggcaggaggatcacttgagccctagagttcaagaccagcttgagcaacatggcaaaaccctgactctactaaaaataccaaaaaaaaaaaaaaaatgctggacgtggtgatgtgtgactgtggtcccagctactcaggaggctgaggcaagaagattgctggagcctaggcctgtctggctaacttggctctaccttggctcagagccccctcttcctttttttttttttttttgagatggagtctcgccctgtcgcccaggctggagggcagtggtgtgatctcggctctccgcaacctccgcctcccgggttcaagcaattctcctgcctcagcctcctgagtagctgggattacaggcacgcaccacgacactgggctaattttttgtatctttagtagagatggggtttcctcatgttggccaggctggtctcgaactcctgaccttgtgatccacccgccttggcctcccaaagtgctgggactacaggcatgagccactgtgcctgccgggtgggtttcttatggcgaatgatcccacaccacttttcagtgcacgtagttacatggagtagaacacagacagtcacacctccacgttcttttggccaccatgactggttcaaccaaggaatctgctccaagctaggtgaaggaaaatcagccctaaggccccccgtcgccacgcacctcactgtatccagctatacctaaagccaaaccgaatcccagacatctaaattttatgagccagtaaattcccttctttgcttaagccagtataaatcagggtcccatcccttgtaatgctgagtcccaaggcccagactctgggcctttcgtttttccattcaggccccagaatgaagaccaaggaagggtttattaacatgacagtgaacatctagggccttatatacatttttcttcaattcagccaagacaagaggcctagaatacagagaaaggacacccatttcttttcttttcttttcttttcttttcttttcttttcttttttgagacggagtcacgctctgttgcccagagtcacgctctgttgctggagtgcagtggcgcaatctcggctcaccgcaatctccgtctcccgggttcaagcaattctcctgcttcagcctcccaagtagctgggactacaggtgcctgccactacacccagctaaattttgtatttttagtagagatggggtttcgcctgttgctcaggctggtctcgaattcctgacctcaggtgatccacctgccccgacctctgaaagtgctgggattacaggcgtgagtcaccacgcccagcctaggacacccatttctttgtttgttttgtttgttttttgttgttgtttgttgtttttttgagacggcgtctcactctgttgcctaggctggagtgcggtggtgccatctcagctcactgcaacctctgctgggttcaagcgattctccctcctcagcctcccaagtagctgggactacaggcgtgtgccaccatgcccagctaatttttgtattttttgtagcaatggggtttcaccatgttggccaggctggtctctaactcctggcctcaagtgatccactgccttagtctcccaaagtgctgggattacaggcgtgagtcaccgcgaccagcctaggacacctatttcttcaaacataggaagaaacatcttatctgcatgatccctcctggggagctatcttacggtcttatgtgataaggtgacctctcctttgggtgagtggagtaaaaaagcgggcgaggtatctggaatatgcttctatccctcctaacctcccctacaaacaaagctttcctgaatgccttgtccttagcttcctggactctgaacctagcttggctaaattttctttttaaagcatcagcataaatcatgaataccttgggaagggaacattaaccatcagccggcaaagttaaaattcccctccagcccacttaaatggactgaaacctccaccccatccccaaacgagcctccctggccttgtccttgaacatttcaaaatcgggtttctgctttaagttctttaaactactttttttttttttttttttttttttgagagggagtctcgctctgttacccaggctggagtgcaatggcacgatcttggctcactgcaacctccacctcctgggttcaagtgattctcctgcctcaacctcccaagtagctgtgattacaggcacccgccacaacgcccagctaatttttgtattttcagtagagacggggtttcaccatgttggtcaggctggtctcaaattcctgacctcgtgatccgcctgcctcggcctcccaaagtgctgggattacaggcgtgagccaccgcgcccggccgctgctttaagttcttaacacgtcctcaccgcggctcagctcactgtacggcccctgcatagagaggggagggcaggggccatgatactgaactcacagctctgggcatttctgaagtctggcccttgaagcttttcctagagcaaattgttttcttctccccttcaggaaactgaaaattcacacagcagccgtgggagtcagagtagcaaaggctttgagatcacatagacctgggacacgtgcttgctttgtgattacgggtaagttccgtagcctctctgagcttccatttctctttctgtggaaaggggatactaatactgcccactgtgagggctgtttctgagattccatgctgctgtgactagcatctgcctgactagcagaggatagttacagtgtcagcgtccatggccctctcatgagactggggcagggggtgggaagggtgtttgggacaccctgggaaccttagcatcattctgccatgggagtatgacctgctgttccctggctgccctcagtctgaggcttgctctgccagtcccgggagaactgtccactcatcatcccggcagagacagatctctttttcgctgtgcacaggtggggaaactgactctgcccagtcacctgagtctgttgacagaggcacctggccatctgtatcctggtcctcagctctgagaccagcaggaaagagaggaggacattcctaatgggggacacagtgaccttcctcctcctgcccctgatgctcccaccactgtggtcccctggtggtgccaaccactcagactccagaagctgagtcccctctcagtcccatgaacaggcaaagctgcttcctgcagaggccccaacctttgcgcctcctcctcagagaatctgattctccctcctcagtgcggttcctttcccacacacacccacacaacaatccagactcagagaatggagtgcctcaaattaggggaaatggccgggcacagtggctcacacctgtaatcccagcactttgggaggtcaaggcgggcggatcacttgaggtcaggagttcaaggccagactggccaacatggcaaaactccatctcccctaaaaatacaaaaattagctgggcgtggtggcgggtgcctgtaatcccagctacttgggaggctgaggcgcgagaatcacttgaacctggatggcagaggttgcagtgagccaagatcaagccactgccctccagcctgggcaacagagcgagactccatctcaaaaaaaaaaaaaaattcaggaaatgatgaggctgcacacacacatgcacacaccacacatggctcatgcatgcacatgacatgcattcacatgcacacatgcccatgcatgtatgtgttcacatatgcacacacagcacctgctcacatgcacacacaggacagtcacacacatgcacacacacgcatgcacatgcacactcacatatacattatacacatatgtacacatggcgcgcacacacccatacatgcatgctcacacatgtgcacacatggtgcacactcacacacccacacatgcatgctcacacatgcacatacacactcccctcttcacccagccaccccgctattcattctggatccccttacccaaccctggttcaggaccacctctcctgacccctaggctaggtcaggccactctcctgacaccctcattactcataggctttctcttcagcacttttaccacgattgtgactaattacatgtgtgatcattttggtaccaggtaatattaatagctcgaaaaatattactgggctttcctctttggcctttctgggtaagtagcccttcccctctcaggcctgaggcacctggctacctggaaaatatttgaatttgtacagaaggaataaagaggaccatggcagatctagttcctgatcatcaacacagactttgctatgagacagtaggtttagaagtcaccgctgcgcactgaccctctgggggcttgggaggaaagtgctctgagaccaccctccagcagcttaggggtggggcccctggaggtgcagcaagttgagaggaaggaagccctggtgtttcgctttccttggccacactggtcccctccgggccaggatgggctcaatgtgttcttgctcaggtaggtgacacctcattaagacaaggggcagagggacctgcagaagggtctgggagtagatggctcaggtaggggtcagatgcagtagagaagagggggctctgaaaaaaaaaaaaaggctgggcgcagtggctcatgcctgtaatcccagtactttgggaggccaaggcgggtggatcacctgaggtcaggagttcaagaccagcctggccaacctggcgaaaccccatctctactaaaaatacaaaaattagccgggcgtggtggcaggcgcctgtaatcccagctactcaggaggccgaagcaagagaatcacttgaacccgggaggcggaggttgcagtgagctgagatcgcaccattgcactccagcctgggcaacaagagcagaaactccatctcaaaaaaaaaaaaaaaaaaaaaagaagagggcgctctgagccaaggtagagccaagtcaaccaggcaggcggaggcccagagcatgagttttacctactgccggtttcggccaaaatgccagaaagccaagcagcaatcttgggcatcggacttggctagaaatccctctcctcctgggaagtctcgtcatcaacacccagacacccccacccccacccacccacccagtgccagcttagagaaaagctgggaggagcagaaggaaatttgagaccaagcattacctaaaggcctaaagtactggatcagattaaattaaatctagttctttttccttgttgccctatgagtaggctttgtgagaaatatcagatccattgcaggaaataaagaaaagacatgttctctgcagacccacatggcaggtgagtaaatgtacagcatggatatccgtcaccagcggtgcattcccctaggcaggcaccacaccgtcctgtggagcattgtgttagtaggcgctcagtaaacacccatgaagtgagtcaatgtatgattaaattccaaccctgcgtggcagcagacaggtggctggtctctgggactggggaagaacaaggctctgtatgtagttggcttcctctggaaggacaggttttaagtcagatccgactgggttcaaaccttggcttggccaaggcagcttctagcatggcctccagtgatcccacctcctggcctgagtgtgggtggacacttctgctatttatttatttatttgatttattttgagacagagtcttgccctgacacccaggctggagtgcagtggtgtgatctccgctcactgcaacctccacctcccggcttcaagtgattctcctgcctcagcctcccaagtagctggaaccaaaggcatgcaccaccatgcctggctaatttttgtatttttagttgtttaggatttgttttagttgtattttagttgtttagggttatttttagttgtattttagttgtttagggtttcaccatgttggccaggctgatctcaaactcctgacctcaagtgatccacccacctcagcctcccacagttctgggattacaggcatgagccaccatgcccagccatgggtaggcacttctaatgagcagaatatggcaaaagggacaggatgtcacctccaagattacgttataaaagacagtgacttccacctttctctctccctctctctcacatgagcacgcgcgcgtgcacgcgcgcgcgcacacacacacacacacacacacacacacacataacttcttggctttcttgctttgacacagcaagctgccatgctggagatacccacatagaaaagaattgaaatcagcctccagccactaatagatagataactaatagcaatagataactaatacagccactcattagctctgccctcagaccagttcttaacctgtatgtgtgtaccctcatctgaaaatgggcataatagcacatccccaccatacaggctaattgtgaggaccacgaaaatgaatggatgggtggatgggtagatgggtagatggatggaaggatggttgggtgggtgaatagatgaatgggtgggcgaagggatggatggatggatggatggatagatggatggatggatggatgagtgggtagatgggtggatgagtgagtgggtggggatgggtaaattggtggatggatagatggatgggtggaaggaagaaaagatggatggatggatggatggatggataggtggatgagtagatggttaggtggataggtggatgggtgcgtggatggatggatggatggatggatggatggatggatgggtaggtgggtgggtgggtgattggatggatggaaggatggatgggtggatagatggaaccactggctggagccgtgtgaatatcacagaatcaggaagtgaagcccaatcagtaagtcccgatggggctgtgaataaccctcactgagcagctgtcacaaggctaagcacctggctgtccccctaggaaagcccctcaccaaggtgaagctctacctccgtcctcacttcacccgcagcccgttcctcctggggctgcaaaggaccagtgcttagagctacctctggtcagaagccagcagagtcctacagtaaaaggggttggggccccctgctgagctcagtactgaagaggaggcatggccaggcagcccagcaccctctgccctccacccagcaacccccaggctagattctgccatccttttctcattgattatgttccccatgaggctgctcttgcccaaaagctggcccagcttgacaccacagagacaaaccaaccaacagccacagcatctgatagccccagtaactgactcttgtgggaaggccgcggccagctggcctgagtcccacagcctgaccatggctccgtcagtggccagtcctgggggcaacagggacacaggggaagggtcaggccccagctctcatggtgtaacagataccagctccaagtcaggagaatggactttccacctgcatgcacgtcacagtgcccagaaccctaacagacatgcatcagacttgacaccttccccacccaccaccccaggtttggctgcccatagaggcgcacacctgtcctcccatctcctcctgggctggagccatgtgagcagaaggggatgtgaagacagatccttgatgtccacaggtgcggggactgcttgccaacccatggcaactcacctgtagcgcatggagatttgggggtaaacccagtgatgctgagtatgtgggctgcccaagctgggtggcaaccaaccccagcattgaatgtgctgagagctggaccggtggatgtccccactgccctgaggcaggtccaggagaaggctcctacctgctgtgcagagggcaaggtaagtcttgtccttgatctacagccagaagacagcagggctgcttctgtctgcgtcccagcctccactcttctctagataccatcaccaccatgacaactgcagttaacacttagtgaagacccctaggtgccacgcgcccatgcaatacccacagacccctctgaggtaggccctgtaatggtccctacgttagggaggggcggtcccaggcccagctggtcagtgagggaggtaggatttgaacccaggcagcctggctttggggcattgctctctgccacgtggccggttcctacacccttgccagctaccccctgcaaaggtggccagcctggctttgtccttcaggatcctctgatctctctcaggggcctccaacccacccactggctctccctgctgacaaagcaactatttcctggccccaaagccccagtctctggaaatgaccctccttccttctccagctcatggctgtcagaggctcctaactgcacccacccccgatcagccaaagccaattactccacgtccaagacacaggcgtgttaaaatgtaaacggccattcatcatctggcagcgtgaccgtttgcccctatcaggccccagtccggcctcaccacgcctccatgctctcctcagcgtcaaagaaacagccttgtcctgccagggccttcgccaggcccggcctgggaagtcagggctctctgacccaatggagcgaatcgttgcgagcatttatttaatagcattatcttgatgatgaataaatcacaccttcatgaaccatttttccatttgtagccccaagtcaagactcccaaaatgttaccagatgtcaggcatgaaatatacacccctggcaagctctgccatgcacaggagtcatgctgctttcaatccacgggagagccggacacgagcgttccaaggcaggagcagaactccatgttggccattataaagacaagattccttttcccccgctttttatagcctctctgggtaagatgtgtctggaaggaggtgtgggccaggaaagagcatatgtctgatgcctgggattccaggacagaaagtacagccgactccaagctcttgggatgggattggagggtctcaaaaccttgccagctttggagtcagagagaaaagagtcccaaccccagatttatcatttgctaacaaatgtgaccttgggcaaatcagctcacctctctggccctcaacagagataatcctgggacctatttcacagtcatggagaggattaaatgggaagaggaataaaaggagtttggagaagtgcccaggacatagtatgcactgagcaaattccgtagtaagaggagtattagtaatagctactattgattaggtggtgttgtgagttgaacagtgttcccccaaaattcatgtccacccagagacacagaatgtgaccatttgtggaaatagggtctttgcaaatgtaattagttaagatgaggtcatactagattagggtaggccctaagtctaatgactggtgtccttattagaagaggataggggctgggcacagtggttcacacttgtaatcccagggctttaggaggctgagacaggaggatggcttgagcccagaagttcaagaccagcctggacaacatactgaaacccatccagtctctaaaaaagaaactaaaagccaggtgcagtggcttacatctgtaatcctagaactttgggaggctgagacaggaggatcacttgaggccaggagttcaagaccggcctgggcaacatagcaagaccccatctctattaaaaaataaataaataataaataaaattaaacttaaaaaatttaaaaattagccagccatggtgggaggattgcttgagcccaggagtttgaggctgcagtgagctatgatcaggccactgcactccagcttgagcaacagagtgagatcctgtctaaaacaagatgggacacacaggaagtggtggtgcaaagatggtgcagccgcaagctgaggaacaacaaggatccctgaccaccagcagaagctaagaggcaagaaaggattcttccttagagtcttcagagggaaagtggccctgctgacaccctgatttcaaacttctagcatccagaactgtgaaagaacgagtttctgttgtttgaagccacctagttggaggtgcttcattacagcagtcctaggaagctaatacaggtggttaccatgcactaggttctctgcattataaatgcatcatatgtgtgaattcacctaaatcctcacaacaactgtaagaggttactataccatgttacagagagagtgatcaagactcagagaagttaagggactcatagctggatctagatttgaatttggtctatctggtctaaagcccacttttaaggaccaactgtgtatgccaagtgctagagccacttccttgctcagtcctcaccgaccacactgtgctatctttattcacattttgcagttgaggaaacaggttcaggcaggtctgtccaaggccaccctatttagggtctgacaaagccaggttcatctgactccaatgccaacgcccatgctgttgaccagaccatccctgccaacttcccaatatgaatgctttgagtggctctcggcccccgggctgtggaacaccagcacaccagtgcctggagggcagcagctgtccagcaaatgtctgctcattcatttgttcacgcattcagggcaagtcgaacggcagacggggcaggagatccagggccagcatcgatggtgcagggagccctctggccccttaaatatcctcagacaatcccagaaatcattcctgggtctaccttatgtgggttttctagaatagctactgctgaactgtagggtagtgagggagagacacaaatacaggcaaaaccacacaacagcgaagattccataagggcaggagtgtttttccaccaggaaacaagaaccagttcatctgagttccttcgccttttgtcccaagacacaaaaatgtcaaaaatgtgcaagggctctggccacagatggatactgtgtctcaccccgacgggctgcttcctgcatggggctgaaggtcagggtgaaggttgctgccctgagagtcaggggaagttggtctgcctcctgctgtgtcacgtacttgccatggtgtgtgggatgaggcccatcatctcccagaattaagctgtagctgactataaaaccacaggtgagggctgggtgtgggggctcatgcctgtaatcccagaattttgggatgctaaggcaggaggttcgctggagcccaagagttcaagaccatcctgggcaacatagagagaccccgtctctactaaaaatacaaaaattagccagacatggtggtgcatgcctgtggtcccagctactctggaggctgaggtaggaggatcacttgagcccaggaggtcaaggctgcagtgagccgtgatcatgccactgtactccagctggggccacagagcaatactcagtctcaaaacaaaataaaaaaacccacaggtgaggtcacatcaggcttttcccctttattctccctaagggctccacaacatcagaaatgggtttctctatcagtgcatcctccagattctactttttttttttttttttttttagtagaggtcttgcttatacccaggctggtttcaaactcctgggctcaagcaatcctcctgcctcattctcccaaagtgctaggattacaggtgtgagccacccacacccagcccagatactgggccctgtccgtcaatccatttgcagtcaccaagcaccagctgcgtgcaccgcattgtgccaatgtctggaaggatgctcacaactatcaacacagataactaataatatcaacaataccacagtgtaaatgcaaagcaatatgtgcctggtctcatttaattctcacatcaaacccttgggatacatatcattagcaccctcatttgctagagaaaactcagttctgagggtggatgatttgccaaggccctgggaattcggactaactcccttcataggtggctgcaagtgcctgtggcccagacattcccatagataggtcattttctcacaccagcttatatttcttgtgccagacacagggtccaaacccatttgcattacgtctctgagacttcacaagaccttcctgtgaatttgttaccattattattattattttcttgttttacttttttttttttttttttttttagaccgagttctgctcttgttgcccaggcctgggtgcagtggcgcaatctcggctcaatgcaacctccacctcccgggttcgagcgattcttctgcctcagcctcctgagtagctgggatgacagacacacaccaccacacctggctaatttttgtatttttagtaaaaatgggttttcaccatgttggttaggctggtctcaaacgcctgacctcaggtgatccacctgcctcggcctcccaaagtgctgggattacaggcgtgagccaccgcgcctggccttttttttttttttttgagacaagatctcactctgtcacccaggctggagtgcagtggggcgatctcagctcactgcaacctctgcctccctggttcaagtgattctcctgcctcagcctctcaagtacctggaattacaggcacgtgccaccacgcccagctaatttttgtatttttagtagagacggggtttcaccatgttggccaggcttgtcttgaactcctaacctcaactgatgcacctgtcccgacctcccaaagtgctgggattataggcatgagccaccgcgcctggccttattattcgtcttcttagtctgctttcagatgaggacacggagccacaggagttacaagggtggaggtgctgggaagtcaggaccaaaatcagcctcctgactccccatctcattttctcaatcatcatgggttttgccccccaagaagagaaccagccaccatgggtgctaaaccggtggctgatatagcaaagtgtgttggagcagagatcccagcgggcttcctagaggaagatcacaaaaaatgggcagagcccacaaggcacagtacaggtttcctctctccagtccacataagggcattcaccaggaacctgggggctgggtggccttggcccaaccctctgaaactcaccctgtggctcctcactcaccagatggacacagcaggaatctgtcccacctggctcagggagggcctacccccacctcccaccccaccccacaggcctgtttgcatgccaggccagagttggccacatgcccacatatctctcctcgttctgcaggctccgggaaggaaagtccaaggccaaggttatcatggggttcacataccttaaggggtgggtggaggggttggctcacaagctacaggttattcaatgcagtgctattcgtgatcacaaaagatcggaactgatctcacgtccatcatcaggggactggactaagatattttggcacaaccacatacgactcaagtgtcaagggaggaagagtgggggagtcttgaataaataacaaaagctggcgttgacacaggactttgcacatggtggaggctccttgcaagtgctttgcatgttattaactcattcaatccttacatcaccccaggaggaggaaccattattatctgtttaaaatgcctgtaatcccagcactttgggaggcccaggtgggaggatcacttgagttcaggagttcaagaccagcctgggcaacaaagtgagacttcatctctacaaaaaattcaaaaaattagccaagcctggtgatccacacctgtagtactagctattcaggaagccaaggtgggaggattgcttgagcccaggaattcgaggctgcagtgagccaggattgcaccactacactccagcctgggtgacaaagcaagatcctgtctcaaaaaaaaaaaaaaaaaaaaaaaaaaaaaaaatatatatatatatacacacacacacacacagagagagagagatacacatataatattttaaaatatatatacctcaaaaaatatatatataatatttaaaaatatataaaatgagggtgccacttggttgagtttatggttaaaaaaaagaataaaatttaaaaaagaggcaccaagaagtgaagtttcttgccccaggttcatggccaacaaacagtggactgggccgggcacggtggctcacacctgtaatcccagcaatttgggaggctgaggtgggaggatcgcttgagttcaggagttcgagaccagcctgggcaacatggcaagatcccatctccactggtgcagtggctcacgcctgtaatcccagcactttgggaggctgaggtgggcagatcacaaggtcaggagatcgagaccattctggcaaacatggtgaaaccctgtctctactaaaaatacaaaaaaaaaaaaaaaaaattagccgggcgtggtggcgctcacctgtagtcctagctactcgggaggctgaggcaggagaatcacttgaacctgggaggcagaggttgcagtgagccgagatcgcgccactgcactcgggcctgggcaatagagtgagactctgtctcaaaaaaaaaaaaaccgtctctactaaaaaactgcaaaaattagccaggcatggcggcatacacctgtagtcccagctacccaggaggctgaagtgggaggatcacccgagctcaggaggttgaggctgcagtgagccaagatcacaccactgcgctccagcctggcaaccagagtaagatcctgtctcaaaacaaacagacaaacaaacagtagacctggaatttggtgcaagcagcagggccagatccatgcttggtcctctcctcccagcatctctgttttgtcctgggtccctctgccaggagctccctggaacccgggaaggaagagaagcatgcagacaagcgtcagcacccccaccctccgctggccttggggagcaggtgtcattagacgaggctcaactgaagcctgcatctgaaacagattctcataactcaggcgctgtggtagccaacttctctctacagtcaattacggccagcggggcccactgattatttttatagcctttcctggagtcatgacaaggaaaactaaatgatccacaggacccctttcatcactaacagccgggtttcacggttgggggtggaggaaggaaagaaaaatcacttttttccccactttgagttaatcaacagaactcaagtctgggcagccaatatgttggtgttgagaaaagctgttctcaagcagaactaattggcaacagaaatggaattttcttccccacctccctaaaaaacataaacatgctttatcccagagaattacccttcagaataggtattgcagacgtgtcgtgtgcagccgcctgtgcgaggctggtaatctcacgccgacctggccaaaggctgcctgtgctggttacagctcaaccagagcagcctcttacgcaatacaatggtcatgaaggtcagtggcccaaaccagcccagccagaccagagtggacacttgctttcctgatgcccagcacctatctcctgctcctacgaacagcctttggcttttgttgggtcggggggtgggagggcaccctgatttgcaggtacaagtgtgagtggcattgataccccctcaactccagagatgagctctgacaggcgtaagccaaagaacatattccggggaaatttcaagaaggggcatatgacctaacaagaaacaatagctggcacagtggctcacaccttaatcccaggactttggggggctaaggcgggtgaatctatttcagctcaggagtttgagaccagcctgatcaacaaagtgagaccccagtctctgcaaaaaataaaaactggctgggcgtggtggtgcatgcctgtagtcccagctacttgggaggctgagatgggaggatctgcttgagcccaggaggtggaggctgcagtgagccaagattgcaccactgcactccagcctgggcgacaaagccaaactctgtctcaaaaaaaaaaaaaaaaaagaaaagaaaagaaaagaaacaataaggcactagaaaaaaaaaaacatataatgaggcttctggaaaagatagctctttttattttagagaaattgaggttcaaagacgtgatgtaactgctcagaggtatacagtgaggtggtaggggatccagggtttgaacccaagtctgtaggactgaggagtttgcaacccttcactgcaggcgctactgaaaggcagcataaaccttggacgaagccagaagagctggattcaaacccagttctgccatttactccctgtgtaatttcaggcaagtcacttaacctctctgttcctcagtttccatatctgtaaagtggggcttctaagggcacctccatttgcaggatctgagaggtaaataattaacagcaatatctgtaaagtgcatgcaacagtgcctgtcacggaccaaggattcgccccttcctcaccacaccgttccccacacgcgttgagaaccagaccaaataaaaggaggtggaggggaggaaggaaaagttgatgttatcagatctgtaatccctacgccatgtgttcctttctgtagcacagctgccaggcttgcctctcctgcaggagaagctgtgccacaaagatgtgggacgtcacaaacacgcagcccattcaaggcttttggacattccagccccgtccttgatgtcagtcaagatctagggcaaattccacccattcaggtggcaaaaagtaagatgtttgacaaatgccatgtgtagagggtggcttgtgaattggtacaaccattagaagataattcagcatacgatttcatattccagcaattctacttccaggtacaaacttgagacacactcctgtatgtgtgcaataggacagtacaagaaccctcaaagcagaaccgtgtatgtagcaaacaaaactgacaaatggaaacaacccacatggtcatagacaggaaaaataaatgctggtatgccatggaatagtacacagcagagaaaagtgaatgaacaagtgataagcaattatatcaacgaattttagcaataaaatgatttataaaaatgtaagtgcaggggctgggcaccatggctcacacctgtaatcccagccctttgggatgctaaggcaggctgattgcttgaggccaggagtttgaggccagcctgggcaatatgcaacatggcaaagccccgtctctacaaaaacgtagccaagtgtggtggtgcacgcctgtagtcccagctaccagggaggctgaggtgggaggatcacctgagcccaagaagtcaaggctacagtgagctgagattgcaccactgcactccagcctgggtgacagagtgagaccctgtctcaaaatatgtgtgtgtgtgtgtgtctgcatgtatgtgccagaagacaagatatatctttacgtaaagttcaaacagcagtaaaagtaaatgatatattattttggcatacatgtaagtgataaaactttttttttttttgagacggagtttcgcactcatcgcccaggctggagtgcagtggagcaatcttggctcaccgcaacctctgcctgccatgttcaagtaattctcctgcctcggcctccctagtagctgggtttacaggcatgcaccaccacacctggctaattttatatttttagtagagacggggtttctccatgttggtcaggctggtctcgaactcctgacctcaggtgatctgcccgccttggcctcccaaagtactgggattacaggcatgagccaccgtgcctggtgataaaactatttttttaagcaagggaaattgagaagatgaaaatgttctggaaatggatggcgctgataattgcccaacattgtgaatgtgcgtaatgccgctgaattgtacccttaaaatggctaaagtgataaattctatccacaatttttagaaaggcaagggaaagctaaacacagaattcaagatagcagctactaccacagtgagagagggagggaggcaagatgggaaaagagttcggaagttgatataaaatggttgtctgagttccagcacgcaggtgggaccatgggttcacaggcatttatcattttataaatagctataaagagattgttagatggaagtgtaggtggggctgttcaggtgccctttcagtatgtcattatggaattatgaatcattcaatcctacttactttttcttttttttttttctttgagacggagtctcactccattggccaggttggagtgcagtggtgagatctcagcttgctgcaacctccagctcctgggttcaagtgattcttgtgcctcagcctcccgagtagctgggattacaggttcatgtcaccacacctgtcttatttttgtatttttagtagagacgggctgtctctactcctgttggtcagactggtatcaaactcctgactgcaggtgatccacctgcctcggcctcccaaagtactgggattacaggtgtgagccaccacacctggtcaattctacttacttgaggtccatttttaaaattctagaggaggccgggtgcagtgtctcacacctctaatctcagaaactttgggaggccaaggcaggtggatcacctgaagtcagtagttcaagaccaacgtggccaacatagcaaaaccctgtctctactaaaaatacaaaaattagttaagcgtggtagtgtgcacctataatcccagctactcgggaggctgaggcaggagaatcacctgaacccgggaggcagaggttgcagtgagccgagattacaccattgtactccatcctgggcgacagtgtgaggctccatctcaaaaaaaaaaataaatccctaccttcaggaaactcacattccagcaggggacacttaagaaaataagaatatatatgtatgttagatgatgagacgtgtgtggtaaggagaaaaataaaccagaaaagggatgaagaagaccagggagtgaaggaagctgtaattttaaatggagagtcaggatggcctcgctgcaaaggtgatgtttgtgtaaagacctgcgcgatatgaacaagtgggccacttggatatctgaagaatgagcacccaggcatagagaaaagcgattgcaaaggtcctggggcaggactgtgcccgacctcaagaacagcaattgtggggagtgggaaggaggagagataaggttagagaggcctgggccctgcaggccttgtgggccgtgatgaggactttgcctgtgctctgggcaaggtgggaccagggctggagataggaggtgtcctgaacagagaaggaactggatctaatttcattttaacaggaccctgctggctgcacacggagagtagaccaggagggaggcaagaggagaagcagagacactggtggggaggcaactgcaatagcccagagagagacaccatggccgctgggaccagggtggagggagcggaggtgacagagctgtcagcttctgggtgcaggttgacaggggagccaacggaatttcttttctgttcctctttgtttttgagacagcgtctcattctgtcactcaggctggattgcagtggcacaaacatggctcattgcagcttcaacttcctgggctcaagtgagcctcctacctcagtttcccgagtacctgggaccacaggtgcatgcaaccacacccagctaatttttaaaaatatgtttgtagagacaaaggtcttgctatgttgaccaggctggtcttgaactcctggtctcaagcgatcctcctgccttggcctcccaaagtgctgagattgtaggtgtgagccaccacgtccagtgtagaatttcttttttgctggaaagtgggagaggctgggctctatttaagtgtttaagggtcaagaaagtttgagacctggttataaagtagagacatggccatccaaactgagcccttcttgagagctgatgatgggatagaatttttttttttttttttttgagatggagtcttgctctatcacccagtgcagtggcgcgatctcggctcactgcaacctccgcctcccaagttcaagcgattctcctgcctcagcctcccgagtaactgagattacaggagcccgccactgcgcctggctaatttttgtatttttagtagagacggggtttcaccatcttggccaggcttgtcttgaactcctgacctcgtgatccacgtgcctcggcctcccaaagtgctgggattacaggcatgagccactgcgcctggcctgatgggataaaattttttaaaaaataggctgggcacggtggcccacacctgtaatcccagcattttgggaggccaaggtgggcggatcacctgaggtcaggagtttgagaccagcctggccaacatggcgaaacccccgtctctactaaaaatacagaaatcaggcatggtggcatgtgcctgtaatcctagctactcgggaggctgaggcaggagaatttcttgaacctgggaggcagaggttgaagtgagcaggatcacgccactgcactctagcctgggtgacagaacgagactctgtctcaaaaaaaaaaaaaaaaaccctcctcttctaggacttctgtgatgtgggcattaaaatgaatgttttaggtcttcatgggctcacatggaaaaatgtccaggacacctgttggttgaaagaaggaagatgcagaataaaatgtatagaatgatcccatttttgaaaattaaaattacgtgacaaagaaaaaaataggaatgaagtgaatgaatggcctgaaagcatagacgcctggctctttctttgttttttttaagaaggagtctcgctctgttgccccaggctggagtgcagtggcgcaatctcggctcactgcaagctccgcctcccgggttcacgccattctcctgcctcagcctcccgagtggctgggattacaggcgcccaccaccatgcccagctaattttttgtatttttagtagagacggggtttcactgtgttagccaggatggtctcgatctcctgacctcgtgatccacccgcctcggcctcccagagtgctgggattacaggtgtgagccactgcgcccggccaagacaacgggctcttaacaggggtggcccagggtgagtataggagctactgaggtttaaactcaggcgcgcccttcctacctcgcaaaacaataaaacacgcatgcttggggccgggcatggtggttcatgcctgtaattccagcacttttggaggcctacgcgggtagatcacctgaggtcaggagttcgagaccagcctgaccaatatggtgaaaccccatctctactaaaaatacaacaattagccaggtgtggtggtgggcacctgtagtcccagctactcaggagctcctgagacaggagaatcacttgaacccaggaggcggaggttgcagtgagctgagatcgcaccactgcactccagcctgggcgacagagcgagactctgttaaaaaaaaaaaaaagaaagaaagaaaaaaaagtgcacgttttttagttctcttttaaactgctgtgggcatggttctcctcttgtattgcagttgcgtttctcttagctaatgtcccacctgggccttgtccttggcctggactataagagagcggaacttgagaatgagaaatattttcctctcgtgcttgctggcttaggcccttaaaactggaaagggcccacctggctcctagagtttctaaaaatagcaagctatctgaacttttcctataggtttggcttagccgttcctctgacttgttccaagatgccatttctgttagggcatcattcgctgtgcatgaaaacaaaggatggcaggagacagactagaaacggaagaggactaatcgggagccgctgcggacagaatccagaaatgccctgcaaatgcagacacagtggacgcaatggagagtgcataccagggcctgtgtcgctggtggagctggggcccacatgccgctagtgtagacaggatctctactccacccgatctctctgcatccactccagtgcttcgggcaagagagaggagtttggctgctggtttaagtgagatggggaaattgaaagatttgcatccaaggcccatgcctggggtctgaattcctttggaagaggactgaggactgttcaggagacgatttttgacaatccagacacaaccatagatgctgtggaaccagtggtatgctggcaaaggtttagcaaccagctctccaagggaaagtgagtgtgtggtgcacaagtgtgcatgggcgagtacatatatttgcatatccacacacacatatacttcggtttattataaattgtattgacgtaggctgggcgcagtggctcgtgcctgtaatcccaacactttgggaggctgaggtaggtggatcacttgaggttaggagttcgagaccagcctggccagcatggtgaaaccctgtctctgccaaaaatataaaaaactagccaggcatggtagcgggtgcctgtaatcctagctatttgggaaggtgagacaggagaattgcttgaacctgggaggcggaagttgcagtgagccatgattacgccactgtcctccagcctaggcaacagagtgtgactccatctcaaaaaaaaaaaaaaattgttttgatgtaaatgatgtgcagcacacaatttacaaataaaaataaaacttacaataccttttcttttataaatgtaatataatcatttcactcacaggtagcagttttgttgatttttgcccccagcaaaatctgtaatcaacctatggttacaattgatgaaggagtgtaattcttcagaaataccagttaatattttcctttctaaaaaatttctaattatttgtttatgtatttttatttttttgagacagtgtcttgctctgtggcccaggctggagtgcaatggtgagatcacagctcatggcagcctcaacctcttgggctcaagcaatcctcccacctcagcctcctgagtagctaggactacaggcacgcaccaccacactcggctagttttttctcaaattatttgtagaaatggggtcttgttatgttgcccaggctggtctcaaactcttgggctcaaatgatcctcctgtctcagcctcccaaaatgctggaattacatgcatgagtcaccacactcagccttgactacctttgtttttcatagaatttattgaattgtaagttcatataatttaatttttaacaatggtgtgtttagcaacccgttcacctaattcctgaaaatctgacaatcagctttcacaagctggcacaagctgcctccagcacacctctgtctggggacaacatggcaaagaatatcaccgaactgaggaggaagccattctcttcacatctgcccagaacccagggtatctcaagcactaaacagcgggaagctttgggagtttacagagatggcaccatggacgctgctgtgctgggcagggaagcatctccaaatggcctcagaggaaagaggaagcaggaaggatgaataaaactagagactggttcacaaaggcactcgaaatacccctttggagctccccaggatgaactgggggaccctggggggagcactgaggttctgatggggaaaacctcagcaaccagtgggcatctgggccaaatcacttagcacaaacgctgagccacaaaatcatgatacgctttcaacaacccattaggcacctcagaagctgcagggccatagggttgttacaaccgacacccatgcaggtggtaccacaggccatcagtccttttccccaagtccaccttcattcccgcctcctccagtaccatcctggacttctctagggaagtggtggggagatttactcctctccaaacttcttttttttttttttttttttttgagacgaagtctcgttctgttggccaggctggagtgcagtggcacgatctcagctcactgcacctctccctccccagttcaagtgattctcctgcctcagcctcccaagtagctgggactataggcacgcaccaccacggccagctaatttttgtatttttaatagagatgaggtttcaccatgttggccaggctagtctcaaacacctgacttcaggtgatccgcctgccttggcctctcaaagtgctgagattacaggcgtgagccaccgcgcccagcctcactccaaacttgatcttactctcagacatcttactctcagacgcttaagttctcagttcggaacttaagcgctcttcaaccagactcatggaatctcagggttgcggagagattttagaggtttcctgaaatagtccctttgttttaaagacgaggaagctgagagaagggaagtgacttgctcaaggtcacagagaaaatccagggtggaactgggtagggtgaccaattgtcccagtttacctgggactgggggggcttctggacaagttgctcccagatctgagaccacaactcagggctgacttgtccccaaggtgggtggtggggggttcacagccagtccctgaaaggaaaggaggcctggatcagtacagagctgctttgggatggaattttccaagggaagaaaaaagaaaaggccacatctgggtgctgggacctttcactctggcccgatgcctggaaccccagggattccccacctgctgtgtgtttcctggcccttgagtgtaacctgcaccctccctttccgtgccagggagacacgagctgactttatctgtctcttatctcttggctgctgccagccacagctgcagggatatatatgcaaatagcttacgataatattaatatgtgattccccccaggggaggcatgtggaaagcgctgtatgcgtttcacaattctgtttcatccaaaaacactgcacgggcccagagtgattcgaaacagattttctgcaaaggcaaaataaaattggaacaaaacctagttgaggcatatgccagtctccctgcccccagctctctccacctctgacatattaaccctcttctctcatgcccccaggagcctcctacgacaaggcagcaaatctaggaaattgcactgggcactcttcgttcaagcctggagcccctgccccatcccagggcagccagcctccaccctgggctgacacatcctttagagagtaaaaggctgcttgccagtgtcagcctgtcactccttctgtcccacctctgcctccttcctgcaggtaatgctccatccatacctccttctccttcacccctgctgcttgggataattgcagaaccatggagcacagaatacagaatactgggggtgtacaggagagtttagccaaagcaagtcagaaaaacctaggtcttttttcgtttctgccactgaccggctgtgtgacctcagcaagtcacttcacttcgcccagctgctgtttcctcagggtacaatgaggacaccaataatacttaccctgcagggggcttaccgggatttcccgagccgacgcttcaaaaatgcctacacagtgcctggcgtatagcagatacacaaggaatagctgtcatcatgagaatctcttaaagatcacctagttcaaccactgttttagaaacggacaaatggaggcctgcagagggcaaataacttgcctaaggccacacagcacgataccgccatcccatctcagcctcaacccaggttccctcctccggccttgggagctccaggtggcctgtgaggaacggctgcctcctcctgtcacccccagctccagaagtctgtccacacaaggcggcgtcacggcacacatggggagcagtcacttcacactcaccatcgagcaggtctggacactcgagtgcagtcccgccgccctccttgcagctgcctcactttccctattgccgccagcaagcgtctgctcccatctggcccgggactcccggactcgagctagggctctgcaaattccatccacactggccaccagccgctggtcccgctctctgggaagatcgccttgaggacctgctgcgccccgagtcttccttctggtgcagggaggccggtgccctgccgggctctgataatgcagccgggactcttatctggcctgtgtcagggtgcaggcggccatggagctggggttccaggaagccctcctggggccccccagccggccccgctccccccggatgccgcctgctgctctggacgcggccgattgcttgtcagtgtcactcccagctctgccggggggaattccatgctggcccccagcaggcggggcccccaccccttcacgtcccaccccccactcccattttggcaaggggactgggaaaaggcagctaatttcaagtccgcacagcgtttgtggtcgtgtcctgaatcctccacgattaatcacagagcatctgatttctgctttgcctcagagaggggcggaggggacgcctggaagtttctgtttactccattctgcaccaggctgcgtgctaatcacaaacagactgggacgcagcctacccctcctaaactgctcttggccaccccctccctcctccagccctctccttcctcttcttaccttgtcactttcctccagccccttcctcactctttctcctttccctcctttctttcccctttcccatctgtccgcctcttcagtccagatctgatccattgcacaccccttccttccgtcctgggtttcccccaagcccctttccccctttgcgcctcccacttctcctagattgagagtcagcttggttctttcctttacatccattagtgagggtcaggctcttttgttatgtttttttttcttttgtataacttaattatttcagggttcggggtgggcgctcgccccttgcccagtcacactggtgtgtgtgcgactcctacaaagttaacagtttctccaggtcaaggggtgggatccaggcttggtgatgtgcacaatttcttttgtccacttgacacatctctgcgtcctgattctgctcagggacggacccaagaacaaagcagccatttaccgcctccggaggggaggccagccctgtggcacatccagggccttggaacacctagagacagatttctctccctcgccttggctcctttccactctgcagctagtgtggaaaagaaaccagaaataaacagcaccaaagaacaggaacggacacccctccccattaaagcacacacacagactctgaagggtaatttggcaaagacctctgaaaaccagagatgagggtctcctactacttatgcctgtgcacaggagacaggcacagagatgcttgctgagagctgcttatcataggaaatgatgggaaataactgaaatgctcatccaataatgactgcttgaacaagatgtgaaagatatggtacatcaggcagcggttttttgttttttgtttcctgacaatgggccttgtctgtcatccaggctgaagtacagtggtgtgatctcagctcactgcaacctccatctgctgggctcaagcaatcctcctgcctcagcctcccaagcagctgggaccagagacgtgacccaccatgcctggctaatttttttaaaacattttttgtagagtcagggtcttgccatgtttcccaggttgggatgaggcagcaaggtacttttttttcttatttttttatttttaaaaataaagatggtgtctcactatgttgaccaggctggactcaaactcttggcctcatgtgatcctctcatcttgttctcctaaagtgctaggattacaggcatgagccactgtgtcagcttagccagcagttttaaaagagctatgtctgtattgaagagcagaggtggatctccaagacatattactgagtgaaaagggggtcagcatgatacatttggtagaatgctgattgtgtaacattccccctttacacacataaaatgaaacactgtggaaacacttagacagcaagacaggctggaaggatgtaaaccaaactgagttgctacctctgggaaaagagtttgggagtgacgcttttacctgtaatcctttcatttctaaaagtgagaatagattggtctgttacttttgtcccagccatcttccttctttttaaaaaatgtgttttattttttatttaaacggagtctcgctctgtttcccaggctggagtgcagtggcacgatcttggctcactgcaacctccacctcccaggttcaagcaattctcctgcctcagcttcccaagtagctgggattacaggtgcctgccaccacgcctggctaatttttgtatttttagtagagactgcttttcaccatgttggccaggctggtctctaacccctgacctaaagtgatctgcctgtcttggcctcccaaagtgctgggattacaggcataagccaccgcacccgacccatctatcttctttggggacattgcacccctatgtggagaaaatttcatcccaaccgtttgcttccttggactaaaataattctaccataggtcaggtcagaaataaacagcattctgcaggaagcagtggctcatgctcctgtaatctcagcactttgggagcctgaggtgagagggctgcttgagggcaggagtttgaaaccagcctgggcaacatagtgagaccctgtctctattttttaaattaataaaataaaataataataattaaaagaaagaaagaaacaggctgagcatgggggctcacacctgtaatcctagcactttcggaggccaaggcagacggatcgcttaacctcaagagttcaagaccagcctgggcaacatggtgaaaccccatatttaataaaagtacaaaaaaaaggccgggcgcagtggctcacgcctgtaatcccagcactttgggaggccgaggagggcagatcacctgaggttgggagttcgagatcagcctggccaacatggagaaaccctgtctctactaaaaatacaaaattagccgggagtggtggcacatgcctgtaatcccagctactcaggaggctgaggcaggagaatctcttgaacccaggaggtgggggatgcagtatgctgagattgcaccattgcactccagcctgggcaacaggagcaaaactccatctcaaaaaaaaaaaaaaaaagtacaaagcaataattagctgagcgtggtggctttcacctgtagctccagctacttgagggggctgaggtgggaggattgtttgagctcaggaggcagagtacagtggtgcaatctcagctcattgcaacatctgcctcccgggttcaagcgattctccccgctcagcctcctgaacagctgggattacaggcacagtgagatcccaccaccatactccaacctaggtgacagagtgagaccccgtcccaaaaaaaaaaacaaagaacacccccagcccccaccaaaaagaaagaaagaaagagaaaagaaagaaagaaagaaaggaaggaagaaaagaaagagagcgagagacaaaaaagaaaagaaaagaaaaaaatgaaaggaaggaaataaggaagaaagagcaatccttaggggtgaacccagaaattctgcaaacattctagtttgaatcacctccggttagatgtccagacccatgagccaacagtgacttattccagagtgaaattccttcagggtaggagagccatcgagttagtttgtagtgggctgaagtctcctggaaatgaggtcggcagatatatattggaaagcaaagatttggtttcaggaagcaatatcacctactctaactaataaaacacaaaaaccactttgaagcattttcaaggaatgaatatgaacaagttcagacattatgcaaagggcagttgagaaagccatttcatttcagccacttcccaccccctcactgactaaatatatggccacatgcatctcaccgacaggacgggcaaataaatggcccttgtgttcatgacaaggagctgtggatagaattctgcagtgtgctcttttctgtccatcacttgttaaacgcctgccagctttgggaaaacagctaggggagttactagacaagacaaatgatattccccacagccccccatcccccacaaccaccaccaatcagggcacccagccctgaccccatcttccagggcagaaggaagctccaggtttggagcccggcagcctcaggtctgggtttccagccttcttcggatgtggcacagccagacctttcagtgtttctcaaagtgggcctcccgaaggggtgccacccaagctgactttagatgacacacagactgggcactaaacactgaatctcatagtgagaaagccatttccctcctatgaccatgctggttcaatgccatttggccgggagaaagtctcagcttgagctagcctgtctttaacacctaacattggccaatctccctttttaacaaagagaaagccggccccacgcttaggtcattccactgctaacagcatctagctagaactgtgtttggcaattgatcatggttttccatgaacattctatttttttggtgttgttttttttccagtttaaaagtgaatccaccagataagggaaaagctaacaaaatcctaataaagtataaagttaaattaacaatagtgtaactataatggttcattggtcttgacaaatgtaccatagtaatgtacgatgaacagttaagaaaaacaataagaaatccgtagagggtggatagagccctctgtactatctttgcaacttttttgtaaatctaaaactattctgaaatagaaagcttatttaagcctggttgcagtggcccacccctgtaatcccagcactttgggagaccgaggcaggtggatcacctaaggtcaggagttcaagaccaacctggccaacatggtgaaacccccatctctacttaaaatacaatacttagtcgggtgtgatggcgcgggcccagctacttgggaggttgaggcagaattgcttgagcctgggaggcagaggttgcagtgagccaatatcgtgccactgcactccagcctgggtgacacagcaagactccctctcaaaaaaaaaaataaaagaaagaaagaaagcttatttaagtacctttagtgccccctaccataaatctatgtttttttttaagtgtatatatggagagaaataaagagaaagcaaattgtaagctaggcgaggtggctcacacttgtaataccagcactttgggagaccaagggaggctctcttgagtccctggagtttgagaccagcctgggcaaaatggaaaaaccctgcctctattaaaaaaaaaaatacaaaaacttaggtgtagttccagctacttaggaggctgaggtgggaggatcagttgaacctgggaggttgaggctgcagtgagccatgattgtgccactgcactccagcttgggcagtgtctgtgcagggtctgctgggcaacggagcaagaccctgtctcaaaaaaaaaaaaaaaagaagaaagaaaagaaaaagcaaattgtggcaaaaatgttaacaattggtgaatctagctaaggggctatatggatgtttttcacactattctttcaattttcctgtaggtttgaaatttgtcaaaatgaaaaattgtagggggaggacgttaatcaatttaaatacaaatattaagtacataagagcccaggttgcaaatgaatatggccaaagttgtgaaggtgggacctgagttggtggcatttggtggaccctaggctacaagatagcctggcaaatagcagggacaactgaaatgattttttttttttttaaagagacagggtccttgaactcctggctcaagtaattctctcatctcagcctcctgaatagctgggactacaggctgaaaccaccgtgcctggctaattttaaatatacatatatatatatacagagagagagaaagagaaagagaaagagagagagagagagacggagtctcgctgttgtcggcccgggctggggtgcaatggtgagatcttggctcactgcaacctccacctcccaggttccagcaattctcctgcctcagtctcctaagtagctgagattacaggcgtctgccaccaggcccagccattttttgtatttttagtagagatggggtttcaccgtgttggccaagctggcttcgaactcctgacctcaggtgatccacctgcctcggcctcccaaagtgctgggattacagacgtgagccactgcacccggccttctttttatttttttgagacagaatctcgctctgtcacccaggctgaagtgcagtggtgagatcttggctcactgcaatctctgcctcccaggttcaagtgattctcctgcctcagcctcctgagtagcagggattacaggcgtccaccaccacacccggcttttagtagagacggggttttgccatgttggctaggctggtcttgaacttctgaccccaggtgatccacctgcctcagcctcccaaaatgttgggattacaggcatgagccaccccggccggactatatatatattttagagatgaagtctcaccatgttgcccaagttggtctcaaactcctggcctcaagtgatccttctgcctcggcctcccaaagtgctgggattacaggtggtgcctggcctgggatgatattaaacgacctcgcaagtccctgagcacccacacccactctccattaccccagaagcttcaccatccatgagggttcccccacataggtgtccttggagagtgcagagggcatttcaagagctcaaagcatctgtaagccttgtagtgagtcgagggaccaactttcatctcccaccccttgacaaccagagagtccctctccctctcccaagcctccacatgcatacactctccaaatgctgcagcatttctcacactgtcaaatgatttctgcacctctattcatcctagagcattctcatcctgttaagagggcaggaatattcatcccagagtctagaacaaggaagaaatactcaagagtggccaacacctgtaatcccagcactttgggaagccaaggcaggaagattacttgagcccaggagtttgagaccagcctgggcaacatagcaagacccccatctcaacaaatactttttaaaaattagccgggcagccaagcacggtggctcacacctgtaattccagcactttgggaggccgaggcaggcagatcatgtgaggtcgggagttcgaggccagcctggttaacatggtgaaaccccgtttctactaaaaatacaaaaacttagctggggtggtggcacgcacctgtaatcccagttactcgggaggctgaggcagaattgcttgaacctgggaggcagaggttgcagtgagccgagatcgtgccactgcactccagtttggacaacatgagggaaactccatctcaaaaaaaaaaaaaaaaaaaaaaaattagccaggcatggtggcacgtgcctatggtcccagctactcaggaggctgaagtgagagaatcttgagcctgaggagtggagcctgcagtgagctgtgatggaaccatgcactgtagcctgggtgacggcaaaaccccgtctcaaaaaaaattttttaaaggaagaaatactccagtgggagacagacatataaataaggacccacggccaggtgtagtgtctcacacctgtaatcccagcactttgggaggctgaggcgggtggatcatttgaggtcaggagttcaagaccagcctggccaacatggtgaaaccctgtctctacttaaaaaaatataaaaattagccgggcagtggtggtgtgcgcctgtaatcccagctactgggaggctggggcaggagaatcgcttgaaaccaggaggcgaaggttgcagtgagccgagatcacgccactgcactccagtctggacaacagagtgagaccctgtctcaaaaaaaaaagaaaaaaaatagggacccacaaaaccaagtgctcagtgcaggggcagagcagtagaggcagggggatggacctctgcctttgaggaccaagggggtatcgcaggaaattatgtcaacagggtcttgaaggatgagaaaacagaaagcttccccgatctttctagattgatactctgacctggccctcaagggagggccatgcccggcagcttaagggtcctgcagagccttttggtctctgaccccaaatccactggaacaatctcagtccttttaaggtgccagcctctctcctgtgtcctgtggttcccccagcctggatctctgtaggtcccacccaccttgcctttcacctggttaataccttaactcaacccgctggaatccagctaaggagtctcaatctcccacagccttctccaagcccccactctgggcacagtgctcctctaccaagcatcctggctgccccatcagggcagaactgggtgagcacatggaccctggagttccatcctggcttctccgcttctgagctgcatgactttgggcaagtaacttggcctctctgggcctccatttcctcatctgtaaaatggggatgacaacagtgccgcattgcgctgctgtgagcattaggtgaaataatacttggcttctcgatgtgtatacagaccagcagattgggcatcccctgggaggttgctggtgcagcatcccaggccccaccccggaactacagaaccagattctgcaatttttttttttttttttggagacagagtctgactctgttgcccaggctagaatgcagtggtgcgatctcagctcactgcaaccctctgcctcccagcttcaagcaattctcctgtctcagctctcaaggagtagctgggattacaggcacatgccaccatgcctggctaatttttttgtatttttagtagagacagagtttcaccatgttggttaggctggtctcaaactcctgacctcaggtgatctgcccgcctcagcctcccaaagtgctgggattaaaggcatgagccgctgtgcccgacgtctgcattttctcaggatctctaagtgattcacatacatgttaaatgtgacaagcactgaaacattatatgtaaaatactgagactgcctgacacatacttggctcctattaaatgtatgttgttgttatcatcatcatcatcatcatcccacagtattgcctgttttctcatcctcctccacctgagaggaaagaccacagagggagcatttaagccagccctagtcagaggagaatcaccaatcccagtggtctgaacatgaatgcctgcaaaccttgccaccaagggctacagtactctgtgtcacgactgccatgggcaccacggcatccttgtgcctagagtggagggggagcttgataaacgctgcgtgattttaagtcatttgtctaattcacatggaaaagccagactggaaccaggcaacatcactcttggctgagcccttttggactcattacttcccaatgctcaagcatcctttggatgaagagcagagacagagcctgagtttggggagaggattaggggatggtgcttaacagaaggaagagtctccaaacctattctacttggtaaaatccatcatttgcctaaggataatggcacaaaaattctcccccatgatcaaccccatctaccttctgccctgatgagaatggtcagattgctggagtctttctggagataaatattctaatccatcactactaggcgtctccgctactctcatcttcacccatcctgagcctcatttcaggcccctttgatcccatgtgactaatctatcagatagaagtcggttctgtggagctggtgaggcctttggaatgacaagctctccctctggcctcaacaaggaccgtaaaccttggttcagccgaggaatgaatctgccctgaaatctgggggccttatcagttttggagattagcaaaggccgagtcctgacctgaaagaaaatcccagacactcgccacactccctttgggactctgcaaagtcaaattttttcagaaaccaattccagttaagtaaatagtttctgcacatgagtgcccacagggttcctcagaggacctgacattctccacttggtgactgtcatttccttacaaacacaacattgaaagcgatctttgcattcccaaaatgattccgccagctgaggaattctacaattcttcttgagttcaaggctgccactttatttattgtgtgcttttatgacaacagcccctaaatgcatcctgtatgatttgataagggcctcttggccccactgcccccatcccatgtgtgtctttctttgccacaaatttccagcacactgttcaaatatgtaccacctaaattgaaccctcatgctgggagcactaatgggacgccccttcaaagcgactttctgtaacccaacagtttacatgttgctggaaacaatggacttaagcacacaatttatttgtgttggctggtttcatgctggttggaatctgctttggggggaaaacaaactctgcatctgtttagatttataatttatattgaaagcacaaatacctcataatagggctagaatgagacccagttatgggcaggagtcaccatatatgctggctttgttctttcatgaatgcactaagagattacaaactgcctttttttttttggagacggagtctcactctgtcacccaggctggagtgcagtggcacaatctcagctcactgcaacctctgcctcctgggttcaagcaattctcctgtctcagcctcctgagtagctgggattacagaggtgtataccaccacgcccggcttttttttttttttttttttttatttttagtagagacgttttgccatgttggtcagggtggtctggaactcctgacctcaagtgatctgcccaacttgacctcccaaagttctgggattacaggcgtgagccaccgcgcccagccgacaaactgctttttataatatttaagccatcctctttattcccccacgcaacccgccgcctccatccctgagaaacatctgcggcaggggccgtgccctgcctgcctgcctgccctctacacaagcactctgatctggctcttttccctgctgccctgtggaggggcctactttgtgcatagtcctggtacccaacatttgggggcttcccgggggggccagccactgttcttagtggcttgcatcaactacctcactccatcctcaccaccctcccaagcaatggcatccccatgatcagggattcctccatgatcaggatgaaactgaggcactttcccaaggtcccacagcttataagtgacagagccaggattctaactcaaagggtcttgctctagaatccatgctctcaaatcttaggtgcttttgcagcaaaatctacagaataagtagctggattgctccattgccttgacttttcattgcagttgagttggaagagaaataaggcaagtggcaagaaaataaaatatcatgcttaaaataaaatatcataaccactaaagcaaaatgagatcatgcttcccaaacgaaaccaaacaagaccaaaacaaaatctggaacagaacatattcacctgagtgcagtggctcacacacctgtaatcctagcacttggggaggccaaggcaggagattgcttgaggccaggagtttgagaccagcccaggtaacataacaagacccccatctctacaaaaaatttaaaaattagccaggcatggtggcacatgcctgtagtcccagctatttgagaggctaaggcaggagggttgcttgagcccagaaggtcaaggctgcagtgagccgtcatcgcatcactgcactccagcctggccaacagagagagactctgtctcaaaaaaaaaccaaaagggccgggcgcggtgggattacacacctgtaatcccagcactttgggaggccgaggcaggcggatcgcctgagctcagaagttcaacaccagcctgggcaacacggtgaaaccccatctctgctacaaatacaaaaaattagctgggcatggtgacatgcaactacagtcccaactactcagatgctgaggcaggagaatcacttgaacccaggagacagaagttgcagtgagccaggatcgagccactgcactccagcctgggtgacagagcaagactccagctcaaaaaaacaaacaaacaacaacaacatcaaaaccctaatcttcttcaccttcttcacctccatcttcaggcccagacaaagagatgccaagaccagaggggaggctcaggctcccagaggatcctccatctgtaagaaagagccacaggtttcaggacaaggggcagaagagcgtattccagggagcttgctgcctgaatcactacaagcagcgtcccagtaaacaggcctcctggaacccgtgcatgtgccagtgctgcctctctcatcaaaggtgagcctatctctccaaccacctgcagcaggttggcactgtgacatgctttgacacacagatgaggtggaagtgactgtgcaccactttggaaccaggcctccactttgcaccttccacctctgtttttactttttttggaatttcttcttttctttttctttcttttttttttttcagatggggtattgctctgttgcccaggctggagtgcagtggcatgaccatggctcactacagcctcaaactcctggcctcaagcaatccacctgcctcagcctcccaaagtgcattagctaccatgcctggcctgtttattggaacttcaagaccacaaatgggaaagaagctgggctagcctcctggaaggtggaagcccggctgggcacggtggctcacacctgtaatcccagcgctttgggaggccgaggcaggcagttcacctgaggccaggggttcaagaccagcctggccaacatggtgaaaccccatatctactaaaaatacaaaaattagtcgggcatggtggtgcatgcctgtggtccaagctacttgggaggctgaggcaggagaatcacttgaactcgggaggtggaggttgcactgagctgagattgagccactgcactccagcctaggcaacagagcgagactctgtctaaaaaaaaaaaaaaaaaaaaaaaaaaaaaagtgtgagctgaaagagccggtgaagtgacccattgcaagaggagggaagaatgcttgaggctgaggggaagaacctgcacaggtggttcttaccaggaggggttaggggaatctagaatctggctccattttacatataaatacagagcactttttgcatagttttaacaaacactaaattttcctggaatgcagtgaccatgtaaattgagagaggcctgtgcttaacttcgttcaggaattcaccaagcactgttcactgctctggagtaacagtcctggcagcaactccacccagccgcaatgccccacacctggatctttctgcaatggtcgctgtcacctgcaaagtgtttccacctgtgagttcaagcacctggatacttcattagaacttccagcattaaagtacatctgatttgattataagtgacctaccatttaatctcctcgattttatagtttgagaattacacatagatgttttcatgatctgagtatgtaggttatattatttatgaatttcatttcagggtagacaaggaggcactaggtctggtagggctgaaaccacaggcatcttcaagcacctcctttggctgtgtgagaagatgaaccaggctgacataagaactaacaagaggtatggagttagagctcagagggccaggagatgatgtcagaggaggatgtggggaaatcagagccctcatgcactgctggtggggatgcaaaaccatgcagccaccatgaaaaatagtctccagattttcaaaagtttaaacatagaatacaattttttttttttttgagacagtctcatgctgtcgcccaggctggagtgcagtgacagtctccactcattgcaacctctgcctcccgggttcaagtgattctcctgcctcagcctcctgagtagcggggattacaggcatctgccaccacatccagctaatttttgtattttgttttagtagagatggggttttgccatgttggccaggctggtctcaaattcctgacttcaggcgatccacccgcctcagtctcccaaagtgctgggattacaggcgtgagccactgcgcccggcccatagaatacagtttgaaccagcaattctactcctaggtatataccccagagaaatgaaaatatatgttcacataaaagcttgaacacaaatgttcatagcagcatagtcataatagccaaaaagtggaaacaaccaaaatcttcatcaactagggaacgaataaacaaaatatggtccatccgtacaatgtgatgtgattcagccatcaaagtatgaactactggccgggcacggtggctcatgtataatctcagcactttgggaggctgaggcgggtggatcacctgaagtcaggagtttgagaccaggctggccaacatggtgaaaccctgtctctacaaaagtacaaaaatgagccaggcatgatggcaggtgcctataattccagctacttgggaggctgaggcagaagaatcacttgaacctgggaggcggaggttgaagtgagccgagatcatgccattgcactccaccctgggtgagggaacgagactgtgtctcaaacgaacaacaaaaaaagtatgaactactaatacatgctacaatgaatggggatgaatcttgaaaacattttggtaagaacagaagccagacacaaaagtccacctcttgtaagactccaattatatgaaatgtccagaataggcaaatctagagagacagaatgtagaggggtggctgccgggggctagggctggggatagtggggaatgatagccagtgggtctggggcatcttttgtaagttacgaaaatgttctggaattaaatagtgatgatagttgtaggactctgtgaatctaaaaaccacatccaaagctgggcgtggtggttcatgcctttaatcccagcactttgggaggctgaggtgggaggatcccttgaaaccagcctgggcaacagagtaagaccccatctctacaaaaaaattaaaaaattagctgagtgtggtggcatgcacctgtagtcccacctacttgggaggctgaggtgggaggatcacttgagtctaggaggttgaggctgcagtgagccattatcgagccactataccccagcctgggcaataaagcaaaatcctctcttaaaacgaacaaacagctcacacctgtaatcccagcactttgggaggccgaggcaggcggatcacgaggtcaggagatcaagaccatcctggccaacacggtgaaaccccgtctctactaaaaatacaaaaaaattagccgggcaaggtggcagtcacctgtagtcccagctactcgggaagctgaggcaggaaataggaaatggcgtgaacttgggaggcagagcttgcagtgagtggagatcgcaccactgcactccagcctgggcgacagagcgagactccgtctcaaaaaaaaaaaaaaaaaaaaaaaaacacatacgaaaccaaaaagtgcatctgtaaatttaaaaaattgtaaaaaaaggaaaacaaaaaagaggaatcactgaactgtacaatttaaaggggtgaattttatggcacgtgaatgatatgtcaaaaagcaaagatgaagctgcagagataaggagggcacacctaggctaatctggagccattgagggctttaggcatcacagtggcaatacaggtttgcgttttagaaggatcactgtggaggatgaactggagatgggcaaaaacagacagctttaaaaggtgacgaagggggccgggcaaggtggctcacgcctgtaatcccagcactttgggaggccgaggtgggcagatcatgaggtcaggagatcgagaccattctggctaacacggtgaaaccccgtctctactaaaaatacaaaaaaattagccgggcgtgttggcgggcgcatgtagccccagctactctggaggctggggcaggagaatggcgtgaacccgggaggcggagcttgcagtgagcggagatcgcgccattgcactccagcctgcgcgacagagcgagactccaccaaaaaaaaaaaaaaaaaatggtgatgaagggtgaggcatttggaacaagcccggctttgggcttgagcagctggtggaggcggtgccattcacaggaatgttggcagcatcgtgttgggagcagtttgcactaacttctgtaacagaggtgcaatcacatacagggttgataagataagagctgcggctgggagaaattacttctgacttttggcatccgggaaggcatttggaagaggtggcatttaagcagaactttgcaggtcagcatagggcatacaaaaattcgaagggcagcctaggaagaatgagttgcaccagcataggtatgggggctaggaaatgcccaggtctgctgggattgtttggccaggtaagatgagaaacaacaattatgataacaaaactaaccaaaaagcatatccttccatttttcacaacctctctgtgaggcagtagcatcttttaataggagccaagattcaaaggagtccaggtgacatacctaaggttacacaactatgaaggggctggccagttttgtttatttgtccattttaagagacagggttggctgggcgcagtggctcatgcctgtaatcccagcactttccatttattctcctcgaggcgggtggatcacttgaggtcaggagttcgagaccagcctggccaacatggcgaaaccctgtctctacaaaaatacaaaaatttcccgggtgtcatggtgggtgcctgtaacaccagctactcgggaggctgagacaagagaatcgcttgaacccaggaggcagaggttgcagtgagccgatattgcaccactgcactctaacctgggcaacagagcaaggctctgtctcaaaaacaaaagagacacggttttgctcttttggccatgctggagtacagtggtgtaatcataactcactgcagcctcaacccccccaggctcacgtgatcttctcacctcagcctcacgaggagagggattacaggcatgcaccacaacaccagctaatgtttaaaaaaatttttttgtaaagatgggctgggcacggtggctcatggctgtaatctccacactttaggaggcctacacaggtggatcacctgaggtcaggaatttgagaccagcctggacaacctggtgaaaccctgtctctaccaaaaatacaaaaattagccaggcatggtggcatgcgcctgtagtcccagctactcaggaggctgaggcaggagaatcgcttgaacccaggaggcagctggagatcacaccactgtactccaacctgggtgacacagcaagattccatctccacaaaaaaaaatttttttttttttttgagatgaagtctggctctgtcgcccaggatggtctcgaactcctgggatcaagagatcctccagccttagcctcccaaagtgctgcgattacaaacgtgagccaccgcacctggctgctggccagtttttaatctcaggtctgtttgaaaaataggtacacaggtgagttcatgccaacttgtggcttgcagaccttatttttacagttaataaagtcattcttcctcttgaactagaaaacactcttctctgcatctctgttttgtattacacattccaatctctctcatctttcaatacgttttcttgagggagaaattgtgttcactgtttgggaaatgtaatctgctctacacaggagatgattaaggactcttgacacttatatgtagggatggagagtatgtatattttaggtgccagagaaaccataatctgtgaacaatatatcaattggggtgatgacagctgcttaatattaaatacgagatgtgggttctttctgctgcttaacctcccttactttgctctgagcaataaccatcaaaaacaaatacatattcgttgaatttttgtttcattctgtttgcattccagctgttgagatataatcctttttatataatacattttaaaaaaatatttgaatctttaccttgtggttttaacagccatggaaaaagtcctggctgggtgcagttggcttaatgcctgcaatcctaacacgttgggaggccaagacaggcggatcacttgagctcaggagttcgagacctgcctgggcaacatggtgagacctccctggtgtctacaaaatatttaaaaattagctgggtgtggtggcacacacttgtggtcctagctacttaagaggctgaggtgacaggattgcttgagcccaggaggtaggggctgcagtaagccatgtttgcaccactgcactctagtaggcaatagagtgagacctttgtctcaaaaaataaaaataaataataggccggggggtgggcggctcacacctgtaatcccagcactttgggaggctgaggcaggcagatcacctgaggtcaggagttcgagaccagcctggccaacatggtgaaaccctgtctttactaaagataccaaaataaaaaattagccaggtgtggtggcactcccctgtgatcccagctactcttgggaggttgaggcagggaattgcttgaacccgggaggtggaggttgcagtgagccaagaactcgccactgccctccagcctgggcgacagagtgagactgtgtctcaaaaatagataaataaataaataaataaataaatttaaaaaataatagataaaaaggctgatttaagggccccatcccaggcccagtgaatccaaatgtccaggagagattgttgtgtttcttgttgtcgttgttttgtttttgtttttgtttttttgagacagggtcttgttctgttgcccaggctggatgaagtggctcgaatatggctttctgcagcctggacctcctgggcttaagcgatcctctcgtctcagcctcccaaagtgctaggattagagccatgaaccacggcgcccaggctactctgcatcctgaccaaaccttaacatggaatctgtgttatttttgtggctgacaccaccagtgccatttgttggttccctctttgccagataaaggtaaagttgtgtcgtgctgccttgggtctgggccaaggtagtctcggcctcttagaaccatatagattttgactgatcaccccattcactcataagtgcagactacatgccagaactattttgtttttgttttgaaacaggggctcgtcgtgtcacccaggctggagagcagtgacacaaccttggctcactgctgtctcaacctcctgggcttaagcaatcctcctgcctcagcttccggggtagctgggactacagatgcatgccaccatgcgtggctaatttttgtatttttttgcagagactgagtccctctaagttgtttaggctggtcttgaaatcctgggctcaagcaatgctcccacctcggggtcccaaagtgctgggattataggagtgagccactgagcccaaccaaaactattttagatactggaaataaagcaggaaaaaaactaagtgtatgtctttcacagagggcttcggggaacttaggttctagcggggaagacagacaaagcaagtaaatatgtccagaatctgtcctgaagcagagagctgggggcttgagggagtggcagaggcaacttcgaaggacctgaaggagggaaagggtgtgggagctagattgcataaaggaggaaagatcacaggagatggaaggctattgtaaatttagcattgactctgaatgcgataagaagctttcaaaaagctttgaccggatgagggacaccatcagacaggttttaccagaatcctttctggcttgtgcagaatcaactggagaggggagggtagatgtggagagaccagagaagagtctactataatagtccaagcgtgagatggtggtggcttggaacagggtagaagatgtggacgtggtgagaaatagttggattctcggtatattttggaggtcaagccaacaggactggatgttgagggttgagagaagtgaaggagtcagggataattcctttattatttttatgatttatttatttacttatttttatttattttattttatttatttatttatttttgagacggagtttcgctcttattgcccaggctggagtgcaatggcatgacctcggctcactgcaacctctgcctcccgggttcaagcgattatcctgcctgggtagctgggattacaggcacctgccaccatgcccggctaattttttatattttcagtagagacggggtttcaccatgttggccaggccggtttcaaactcctgacctcaagtgatctgcctgcctcggcctcccaaagtgctaggattacaggcatgagccgccacaccaggcctgattgattgattgattgattttgagacagggcctccatatgctacccaggctggtctcgaactcttgagctcaagtgatcctccttccaaagtgttgggattatggggtgtgagccaccacacccagcctggggataattctaatggtagtcatctgcaagatacaactgcaaagatggagctgtgatctgcttcttgatgaagagggaggtggggagttcagtgtggaccatgttaagtgtgagatgcctactagacagaaataatggaagggccgagtaggcaactatatatgcacgaatggagttcaggggagaggctggggacagaaatatcagtgtgaaggccaccagcacacaggtggtattgaaagccatgacctggatgagatcacctggaaaagaagtcaaagaagagaagaggtgcttggacaaggaggtcctcagcattcagaagtgggggccaatcacagcttcactccttggctgggcactatggctcacgcttgtaatcccagcactttgggaggctgatgtgggaggatcgtttgaatccaagagttgaagaccagcatgggcaacatagcaagatagtatctctacaaaaaaaatttaaaaattagccaggcatggtggcatgtgcctatagtccaaactaccttgcaagttgaggtgggaggatcgtttaagcctgggaagttgaggttgcagtaagccatgatcatgccattgcactccagccagggcaactagtgagacccggtctctaaaaaaaaaacaaaacttcactccacagatgggggatctgaacgtgatcaatttagtcaccaatctctggacctcctttggtgtgctgagagtggaggagagcggaaagagaactggatttacgtccaaaagacctgccctctgtcatttactgtgggaccctaagcacagcatttcacctcttgggaaatgctgtggaaaccaaaggtggggggttggggccagagcctggagaccttggaaagaactgagtactatgctaagggagggggaagggagggggcagggcaggttgctgcccctgtagccctcagcagaggcctcctgtaactcctctggatgtggcttttagttctggcaggaggtgatgagtgtctgacctggggatgctgttacatgctaacaggggaagaccagcatgttagaggttgtttttttgttttgctttgttttgttgttttgagacatggtctcactctatcgcccaggctagagtgcagtggcatgatcatagctcattgcagcctccaccccctgggctcaagagatcctcctgcctcagcctcccaagtagctgggactgcaggcatccaccaccatgctggttaatttttgtattttttgtagagacagggtttcgccatgttgcccaggctggtctcaaactatccgcctgcctcagcctctcaaagtgccaggattacaggcatgagccactgcgcctgcctgtgttagaggtttagaatcaggcagccacttgaatatggacagtgacggagaaagagggttcaaaataaagttagagtcctggatgactggagagatagtggtgctgttatcagagatggattacatgggagatagagcagtggaagacaaatgataatacttaggacacaaagagttcagagagggattaaagtgtagggagtgtccatggaattttggtacatggccacttcttgtccttaaatagcctccaaacccacagaaacattatctttccatatcaccctaaagactgtgcagcagtgatgagtaaaatgactctgacctcaattaaatcaaaattctaggaatacaccagctcctttggagtttcttactaacgctcctttctctgtctctgattccccacttgcagctcagacagtgccctctgttggaaacctcaaccacaaatccccgtcctcgactccatggcgagaaggacctagaaggaaacaaacacctcccaggagcctttcacacacattgttctcattttatccttgcagttgcttggtgaggttactgtgtccaacctgggcaaactgaggcagctgccccaatcacagccagagcggagctgagatcggaactcaaggcggctgccttcaaagcttgtgcttcactccctctacctagctgtagctgtaggatgatttgacaagggacttgaagatacaatctcaaggacagaggtttgtttttttttgtttttttgttttgagatagagtctcgctcagtcacccaggctggagtgcaatggtgcgatctcggctcactgcaagctctgcctcccgggttcacaccattctcctgcctcagcctcctgagtagctgggactacaggtgcccgccaccatgcctggctaattttttttgtatttttagtaaagacggggtttcaccgtgttagccaggatggtctcgatctcctgaccgcgtgatcagcccgccttggcctcccaaagtactgggattataggtgtgagccaccgcgcccggctactgttgattcttttttgttggttggttggttggtttttgagacagagtctcgctctgttgctcaggctggagcgcagtgtcccgacctcagctcactgcaacctccatctcctgggttcaagcaattctcttgcctcagcctccctagtagctggtactacaggcacatgccaccacgcctggctaattcttgtatctttagtagagacgaggtttcaccagaccttggccaggctggtctccaactcctgacctcaagtgatccacccgcctcagcctcccaaagtgctgggattataggcatcagccaccgtgcccagcctctgtcgaatcttaaactaaaaaattaaagtgtgtattttgtatgtctttgaggttttaaaatcttatttttctggtaatttatttttattatattttacagcagtatccacctgcaacagttggacaatttaaaaaaccagtactttagcactctgagaggcacggggctgccggagagagaagagttgtctaaactgaggaaggtagccaggcgcggtggctcacgcctgggatcccagcactttgggaggccaagagggcagatcgcttgagcccaggagttcgagaccagcctggacaatatagcaaaaccccatctctatttaagtttaaataaagaagaatttaaagaaaaaataaggtgtggcaggtcctccatgtttggtgtatgaatgaatacatcactgaaggaatgacgtatgagtgtgagagaatcagccacatgaagaaaaatgcccagaatccaggtttctcatttagagccattcaaagggtgagagcttaggatgtcaagttcatcaccagacttgatatgcacatcactaaacctgcacccttctgattttaaagatggaggtgggagacctttctcccccaagtcatagaactgatcaacaaagaaaaaaaaataccaaaaagagccacatataaataacaagcaatatttactgctcgtgattttaaaactcagactaggttagtagactaagataaacattctccttaccattttcaccaagtaacaggaaaaacacagcccatatgcacaaacatcctattttaaggactgctggtttttgggttttgttttgagacagggtctcactggagtacagtggtgcggtcatggctcattgcagcctcaacctccctggctcaagcaatcctcccatctcagcctcctgagtagctgggacgacagtcgaatgccaccacacctggctaattttttaattttttgtagagacagggggttgcccaggctggtcttgcactcttgcctcagcctcccaaagtattgggattacaggtgtgagtcaccacatccagtcaaggactactgtttgaagtggaggcttttgaacacacttaccctgggatgatgaaactgaagagtgagcaggatttagccctagggtacaagttcctcaactaccttgaagtgcttcaactgtgcaggaaacaccttccacctaaagtttctgcctctaaacaggagcaaagatgccccactcaagaaaagttccaggcacaccttgctccgttttggaaattcccactggcactttccagaaacaagtaggtccctttaaacttaaaggcacctggggccaggtgcggtggctcacgcctgtaatcccagcactttaggaggctgaggcaggcggatcacctgaggtcaggagtttgagaccagcctggtcaacatggcgaaaccccgtctctagtaaaaatacaaaaattagccgggcatggtggtgcgcacctgtaatcccagctacttaggaggttgaggcaggagaatcgcttgaacccaggaggaggagattgcagtgagccgagatggtgccactgcactccagcctgggtgacagagtgagactccatctcaaaaaaaaaaaaaaaaaaaggcacctggaatatgaaaattgcatttttttttcctgcaaagttgtgcagtagaaagcaatgtcagagtagccctcagtcctcatcccaggctactcccattcttcttggcataaatcttttaggcaaacctatttattctcccctctaaagtgtcaatttcacatctgcaaatgggatcataataataatagtacctggattaaggtgaggattaaatagcaaaatgtgtgtagaacccttagcttgggcctgacacagtgagcctttgatgaacacaagcttggggctgtctctaatcacaagccaaaatagaaacccagagaagtctggaccagtgacagataccatttattcagcatgtgccatgtgccagaaacagtgttaagatctttattagctgttgggatgcttttcttttttctttttttttttttttaagaaacagggttggctgggcgtggtggctcatgcctgtaatcccagcactttgggaggctgaggtgggtggatcacttgaggtcaggagtttgagactagtctggccaacatggtgaaaccccatctctactaaaaatataaaaattagctgggagtggtagcaggcacctgtaatcccagctactagggaggctgaggcagaagaatcacttgaacccaggaggcagaggttgcagtgagcagagattgtgccattacactccagcctgggcgacaagagcaaaattctgtctcaaaaaaaaaaaaaaaaagaaagaaagaaaaaggaaagaaaggaaagaagagaaagaaaagaaaagaaagaaagaaaggaagagaaagaaagaaacagggtcttgctctgtcacccaggctggactacagtggcacaatcatagctcactgcagcctcaaaattctgggctcaagcaatcctcccacaccagcccctcaaagtgctgggattacacacatgagccagcatgcccagcgctagtggaattccattttttctttttttcctgtgtgtgttttttgtttgtttgtttgagacagggtctcactgtgttgtccaggctggagtgcagtggcacaaacatagctcactgtggcctcaacctcctgggtttaagtgatcctccttcctcagcctcccagttagctgggactacagtcatgcaacaccacgcctggctaatttttgtatcttttgtagggatgggatttcaccatgttgcccaggctggtctcaaactcctgaactcaagcaatcctctcctcagcttcccaaagtgctgggattccaggtgtgagccgccacacccagtttggtagaattcttagtacaactctttggagtagctactctcagtgtctcattttattttactttttatttatttatttttgagacaggctctccctcttgtcacccacgctggagtgcagtgacatgatcacagctcactgcagcctcgacctcccaagctcaagtgatcctcccacctaagcttcccgaagagcttggaatacaagtgtgtgttaccacacctggctaattttgcagagatgaggtctcactatgtggcctaggctagtctcaaacgcctgggctcaagtgatccttccaccttgacctcccagagtgctgggattccaggtgtgagccactgtgcctggccctgcatctaattttagagagccagaaaggtgaggtcccctgtccaagctctcccagctcagagagactccctgccttgctccccatcaccccacttgcatgacgttcatgctgccctcttctgtcctcttctgtgtttctcagcctgaaagcgtgggcatcaactctggctggctttgttgttgttctcaagcttctgtcatcattggtataattttacataaacttggcattcctttaaatttcagaaaatatgttcacttcttaaatatctcctgggggagataagagttctataaatgatttcgttctccccgccttcgtgttgaacttaaaaaggcgaagtcactggatctccgttaacaagtcatgttgtttattggtttattttcattttggaaactcttctccatggttaaccactcttcctcctccttaaaaattcccatgaggaattcggatcagacgctggggctgtggggcagatccccgggaggatatcatgtttctagaaggctcctggaagccaacaagcattgcaacctgactcttaactgactttttacctgtaggattatctcggggcaggaggaaaaagacacaggcaagctttctggtcccaaataaaatgatgtatttcgtgaaggaagaaagttttaaactaataatagaaattcatttgaccataaaaaaggcaatataaaagggtaaggactctggaacccaactgcttgggtttcaataccacacagctctgccacttatctgtgtgatgctggccaagctatttaacgtctctgtgcctttatttccaatctataaattgaggatgataacagtacctaaatccatatgttttgatgaagataaaatagggtatacaagggactggaaggtttcttgggactctcaggactataactgggaaagtcacaagcaaactgatatgtgcccatcaccttaagatgaaatgagaggccgggtgtggtggctcgtgcctgtaatcccagcactttgggaggccgaggtgggcggatcacttgaggtcaagagttcgagaccagcctggccaacatagtgaaactctgtctctaccaaaaaatataaaaattagctaggcatggtggtacgtgcctgtaatcccagctactcaggaggctgaggcacaataatcactttaacctaggaggcgggagttgcagtgagccgacatggcactactgcactccagcctgggtgacagttagactccatctcaaaaaaaaaaaaaaaaagatgaaatgagagtgtatatgtacctttattttatttatctgtttttaattttaaaataattttttatttattaattaagatggggtctcactgtgttgcccaggctggtctcgaacctctaggctcaaggagtcctcccactttggcctctcaaagtgttgggattacaagcatgagccaccaagcccagcctacatgtacctttagaaacaacacctgcacattttttttttttagacggagtctcccactgtcgcccgggcatgatcttggctcactgcaacctccacctcccaggttcaaataattctcctgtctcagcctcccaagtagctgggattacaggctcctgccaccatgcccggctaattttttgtatttttggtacagacggggtttcactgtattggccaggctggtcttgaactcctgaccttgtgatctgcttgcttcagcctcccaaagtgctgggattacaggtatgagccaccacgactggccaacacctgcacattttaatgctccttcatcttttctgtttctattcgtggctgcctccagccatggttgattccttgccatttgtaactatggtcctcatttcctcaatatccactctgcaggggcccatgatatgccttttattcctatcactacactgacttgtttcccaaagttccaaatacatgtcctggccagtcacgggacagccattaagagaatttattaagtgccaggcaaagagcttttcaacaaatccttcagacttttcttcttcctcaattttcaggcgacacgtaacttaaaggttaaaatggggatgataatagtctcctccccttgcgtgaatgcccacaatggtttttgcttatctgtccactcctcctctgtctcttaatagttgaagagcctggtgtggtggctcctgcctgtaatcccagcactgtgggaggcagaggcaggtggatcgcttgaacccaggagctgaggccagcctgggcaacatagtgagactccatctctacaaaaaaataaataaaattaggtggacatggtggcacatgcctggggtcccagctactttggggggctgaggtgagaggatcgcttgggcctgggaagtcaaggctgcagtgagctgtgattgtgccactgcactcctgtctgggcaacagagtgagactgtctctaaaaaaaaaaaaaaaaaaaaaacacccaaatagttgaataatatgaattatagtgacaattttttgagagcttactatgtataatactaggcactatatcaaaccccttaaaaatatctcattggatccttatgaaaaatccaaggaataggtaccattattatccccattttacagatgaagaaactgagtcaggaaggccagctcacttcccctagtggcagaatcaggacttgaacccaagtatgactccagagtccttgctccaagcatttcactattctgtttcctcttccttctcctgcctcaactgtgctttctggacaagtttctgccttgatgacaaggctctgagcaggaagcctcacctcttcaagactcagtctgctcttcttttttttttttttttttttttgagatggagtcttgctctgttgcccaggctggagtacagtggcaccatctcgactcaccacaagctccacctcctgggttcacaccattctcctgcctcagcctcccgagtagctgggtctgcaggcgcccgccaccacgcccagctaatgttttgtatttttagtggagacggggtttcactgtgttagccaggatggtctagatctcctgacctcgtgatccgcctgccttggcctcccaaagtgctgggattgcaggcgtgagccaccgtgcccggcctgctcttcttttttttgaacaatataaacatggtgtattaacaccaaatagttgtgaggatggaacgcttgtgaaatgcatagcacagtgttcccagccactgtgatcagtattatagaagaattttgattattactccatcagtatgttcctgttgtagactgaattgtgttccccaaaaagataggttaaagtcttaatctccagtacctgggagtgagaacttattaggacatagggcctttgcagatgtaataaaactaaaatgaggtcaggcctggcatggtggcttacacctgtaattccagcactttgggaggccaaggtgggtaggtcacctgaggtcaggagttcgagaccagcctggccaacatggcgaaaccccatctctactaaaagcacaaaaatttagctgggtgtggtagcaagcacctgcagtcccagctacttaggaggctgaggcaggagaatcacttgaacccaggaggtggaggttgcagtgagccgagatcatgccactgcattccagcctgggcgacagagcaagacttcacctcaaaaaaaaaaaaaaaattaaaattaggtcattagagtagtcctaaatccaatcgctggtgcccttataaaaatagacacagaaacagacagacagacagacacacacacacagagagaacaccacgtgatgcatgtgatgatggaggcagagctcagagtgattcggctgccagtcaaggaacactagtgattgctggcagccacagaggctgggagagaggcacggaacagcctgtccctcagagcctccagaaggaaccaaccttgccaatacatagatttcagacttctggcctccagaactgtgagacagcaaaattgtgttgtgttaagccacccagcgtgtggtactttgtgaacaaatacacttcctggccaggcgcagtggctcacgtctgtaatcccagcactttgcggggccgaggcaggcagatcacttgaggtcaggagttcgagactagcctggccaacatggtgaaactctctctacgaaaaatacaaaaattagtcaggcgcggtggtgcacgcctgtaatcccagcgactcaggaggctgaggcacaagaattgcttgaacccaggaggcagaggttccagtgagctgagatcaagccactgcactccagcttgtgcgacaaagcaagactctgtctcaaaaacaaaacaaaacacacacaaaaaacaaatacagttcccttccacagcctaagtccagaccttcacattctgtgcaagttcctcttccaagggcctcttcaaatgcaggcctgcctgcagctctctttcctcaaatctgtcttaacacaccaatttctgactcccgggtcaaaaacctgcgatgacacctgaatacttacatcagtatttcctaaagttgcttgagataaggatcaccaggatgacagtccaaattacaggttccctgctaggtgtggtggctcacgtctgtaattctaacactttgggaggccaaggcaggtggattgcttgagcccacgggtttgagaccagcctaggcaagaaggtgaaaccccatctgtacaaaaaatacaaaatattagcccggtgtggaggcgcacacctgtagtcctagctactcaggaggctgaggtaggaggcttgcttgaacctgggagggcgagactgtagtgagtagtgattgtgcaactgcactccagcctgggtgacagagtgagaccttgtctcaaaaaataataataattataggtttcctgggccccgctccagactaccagacatgagatcacagaagaggcgcttggaatctgcatttttaataagcacccaagacaattcttttcctcagtcacatttgggacactctggcctacaagataaaatctggaagagactaaagatcttgcctcgatgatctctataaaatggcgccagcctccccattcaaatgtcatctcccaaggcttcccactgtctttacatccctccatgtgaacagcctgcctcactgtcctcaccttgatcaacctctgctcaaacctttgttcttgccattctcctgcccagaacacctcttccttttctcccatcatctaggtctgattcagatgccacagatcttaaaattatttctaattgttccaagatagcttctcaatgacctcagaataaaattcaatgtccttgtcatagcctgcaagaggctgcatgatctggccatggtcggtctctctctctctcttttttttttttttttgagatggagtcttgctctgtcacccaggctggagtgcagtggcacaatctcggctcactgcaacctccacctcccgggttcaagcaatcctcccacctcagcctcccaagaagctgggattacaggtgtgtgccaccgcgctcggctaatttttgtatttttagcaaagatggggtttcaccatgttggccagggtggtctcgaactcctgacctcaagtgatctgccctcctcggcctctcaaaagtgctgggattataggcgtaagccaccatgtctggcctcagtctcattttaagccattcttctccttcactccaagctccaggcctggtcgggtacagtggctcatgcctctgtctaagcaaaggcatgtacacgtgcatggatgcacacacacaagcacacacacaacacacacacacacacacttgctccactcatttcactcactgtaccctgtttgattagttgccaacatttaaaaatcaagaagtttcacataaaaacgtccagtctctaactggatgcagtggctcatacctgtaatgccagcattttgggagaccgaggagggaggatcgcttgagctcaggagttccagaccagcctgggcaacatagtgagatctcatctctacaaaaaaatataaaaaactagccagttatggtggcacacgcctgtagtcctggctgctcaggaagctgaggtgggagaattgcttgagttcagggtttcaaggctgcagtgagctatgattgcaccgctgtactccagcctgggcaatagagcaagaccctgtctctgaaaaaaacaaacaaaaaccatccagcctctcttaaagaatcagatctgcccacttcaaagccctccttcccacgcagctggagccatatggactggaggtgagtcccttctgcggggcggaagctctggtcccctgcagtccccacccagcctctccttccaccccacattggtgcacttgctgactgtctctcacccttgtaacctgggcatttagcctgtgcctggctcttagctacaccttaataaatatgtgctgaatgaatgaaaaaatacatgaatggatgccttccctcctccctaaaccccccaggccacaccacttatttggccatttaatcacagccttccttgcaagtctcactaatttgctgccccactgcctgcctcctcagtagatgttattaaaacacaaatctgattctttcattccccagttttaaatgtgtggagtctcccagcataaactctgcaccatggcctccgaggcccttctcaatctgcttcccacctacttttccagtcccaatctccagagagggcccccacccagcgcacacccacgctctacgcgctggctggggaatacaccatgttctttccctgcccccacaccactgcctgtgaagctctgtctcctggaatgcctcctcccctccgtgcctctagcaaactcctactcattcttcagccctagcactaagtcacttcacccgtgaaacactccagaccccccctgccccggggctgacttagtcattctctctctgctgctcccactcttctcctttcatcccctggccttagcactgagtaatagcttaaaatagcagctggtgctttctgagccctgttgtgtgccaggcaccaagtgagctttatctcccttaatcctcacgccccatcctgagtcccggccccctaaacctgcagaaacacaaggatcactttctcacctccaatgtcccagagaagccatcttgctaccctattttaaattttctttctccctccactcctcactccaccacctcaggcctcccatcccacttcccagctttattttcctccatggctcttatcacttacacactatatacttaaattcatttatttgcaaatgtcagctccaggattttgtctttttttaacactacaatttccttaacatctggaatactacatggggccgggtgcagtggctcgtgcctgtaatcccaacactttgggaagccaaggtgggaggactgcttgagtccaggagttcgagaacagtctgggcaacatagtgagaccctgtctttttttgttttgttgtgttttgttttgttttttgagacggagtcttgctctgtccccccggctggagtgcagtggcgccatctcggctcaccgcaagctccgcctcccgggttcacgccattcagtgagaccctgtctttacaaaaatttaaaaattagccaggagcagtggtgcgaacctgtagtcccagctacttgggaagctggaacgtttgctggaggtaggaggatcacttgagcccgggaggcagaggttgcagtgagctgtgatcatgccacggcactctaacctggacaacagaatgaggctctgtctcaaaaaaaaaagaaaaaaaaatagactagtacctggcacataatagatactcaatcagtaataattttttttttttttagatggagtttcactcttgttgcccaggctggagtgcaatggtatgatctcagctcactgaaacctctgcctcccgggttcaagcaattctcctgcctcagccctccgagtagctgggattacaggcatgcaacaccacacccggctaattttgtattttttagtggagacggggtttctccatgttggtcaggctggtctcgaacccccgacctaaggtgatccacccgcctcggcctcccaaagtgctgggattacaggcgtgagccactgctccaagccttataataataatttgttttaaaaaaagaatagagacagagtctcactatgttgcccaggctggtctcgaactactgagctgaagcaatcctcatgcctcggcctcccaaagagctaggaaacaggcatgaatcatcacgcccagcctcaatcaataataattaaatcaaagaaggtagatactattactaccttcattttacctgaggaaacaaagattgagagacaagtgtccagggttccacagcggggtggtggcagaaccgcatgtgacccctgaatggtcaagtctagtgcccgcctccttagctgctgtgcccaccatctccaggggagtttatggttccctctccatgagtctgacttctcagctcgaccctgagttccttggaggcaagcactctgtcgcgttcatgtctgtttctttgtctgatccatggtaggtgctccaggaacgtttgttggagcagtctgtccatggaaggtgcagtgctcaacggcaggaatcaatcacagtgtcattctttcgttgttgttttcctttatctccatgcacaatgttatacatacagttggggctcattacatacatgctacattaatgaattatattatgacagtaggtaataaaaataattagacagcaataatgacaataatatgtaacacttagggcatccttactctccgttgggcactatcctaagtgctttgtatatgaattaaaacaattcattgtcttattatgctcattttacggatgagaagacagaggctcaaagaagttaagaacttgcctaaggtcacatagttagaaaatggcagaggcaggactcaactgtatgtatctggcttgagtcatgctcttaatgattgctcttggcctctctgagggatgtctactgagaggttacccggtgtgaaaacaaaaagaagcatttatttattacacatttccattttatttcaaggaactcctttcaaaggctttggtaggcaacattatttgctaaatgaaacccagtaatatctgtaccagacttgatggtttgcagagcagtttcatgtatggttcctcatctgagccctgcaacaatctggtgaggtaggcattgctgtctacttctgtttatagaggaacagaggagaaatctgaggctctgagtggttaagtgaacagggtcaaggtcacccagacagcaaggagcagagcaacgactcaaataaatgtctatcagtttaaaaaacaaagatctgatgcctccaaatatgaagttatttcatgcaacttaaaatcaaataagtaaatagcagcttagccagtttctggcacctggtaggtctcataaatgttaactatcaactatcttcatcaacacctcctgggaagtggaatagtttggctgatgactgcagcctgtctgttgaccctgatggaaagattattattttcattccagttcatccctggtaatgttgaaataatgatcaatctccattatccctggagtaccatagaatgttatgagctggaaggggttgtggagatgatctcatcaggtcctgcatttacagatggagaaattgagtccgagagaggggtcagaaagcaaacccgtggcagaccaagccaagggcaaggcttaggcaccgtgcctggcacatactgcctcctgcaaagctgagtttttacctaaaagggctctcacgtcctaaaggctacagaaaacaattcattcgtctctctgtctgtgagcaccaccaccccagctccgcgcaaaaagcagtacagtattataagctattaaccagaaaacagatcatgtgacttaattccacctctgctaaagggcttaaaatgcttcagtgagtagtctgatattcgtaaatatacacttcaactatttctcaaagaatgattaaccagctccatcagaattggaacttgtgcaatcaaggagaaaaagagctggcaagagaaatttattgaaaaaatttttaccagcattacagatgacttcttgccaccttttttttttttcctaagagttagaggaagaaggaaaggaagaagaatcattacacaataatgaattaagaaaactaattgtggaaaattacaaactcctttcacctcacaaggtagctttcaaacaaacacaacagggtatttgtagaacctaaagacacagacagtattgaaaaggagcagaaagcaggagtgtaaccttcactaacttctttcagagagtggagaggcctgacagtgtatgggcgtgattatctctggtagcccattctggactaacgattctgtgaacctataatttagagagtccataatgtcatatgttcaccttacttatctccctaacccactgagtattaattctcccaggcaggggactagctttttaggccacttgtaagtcttgatcagctttagcttgaggatttgggggtggggagggatgatggacagaaataaggttagggttagccttcaaatggaagaaacgggaatataaaatcctcgtctgtgctgatcatgcttctcaagaaaggctgaaattcaggcccagtgaacacacttgtggccttaacatctctcagaatgaaaggattttcttccttcacaatacctttatcaaattccaactattttctacttttcttccttatacaacccaggcgcacgggttgaaataattttccttaagaaatccaggaagctctggcctggccctccctctagaaaggaaagtccaagtaaagagggatgccacacctggggaagggagagaggatgtgacgacacctccaggaatgcagggcccacgcaggtgcactggcacccacgaacttcctgataaatcagtaccgataacaggagtaaaactcaaccacccaacactcactcacacagagctggggtgctgctcccagggtgtggccttgccaatcagggagaggaggaggagacctaagaacggagctctctaaaggtggtgacatggtatctagtccagccatgatcagagtgtggtctctgggagtccctgagacccctttacgggggtctctgcaaggccaaaactgctttcacaaaactaagatgtcatttgttctcatcattcccattgtctcacgagtatacaatggagttttccagaagggacaagacatgtgatgacatcatcactctgatgactgttggaatgcatgcttgtgtactcccatgttttggacacatccgttttaattctaagataaatattgaaagacattacacataaacaaagtactttggggtcctccatgatttttaatagtgtaaaggggtcttgaaaacaaaaaggttgggaactgctgtgctagtccaaacaggggagttacaggccctgacatgcactttatttccggctgaacttgagtcacctcctatgtgctttcaaacagggggtggaggcagcttgcttatttattatacagcttggattggtgtcctttccacctgtgctgccacaggtggccagaaaaaccttaaatcctcccacaaaacgtctggttacctgaatcctccagagggaaaaaaatgagcttctcgcctttgaacccaagtggggcaaagagcctgcagaagggacaccctcagtggcagcacccagcaaagacccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcagggagatgaggggaggaaggtaccctaaccactcttcttgccaaatctcaggttggaccttcccctccacctccattcccctgcccccttcctggcttgcaggtttcaacagctcttggattcccgggtcccacagggagaccttgggacctgggaatctcctccagccaaaagcttcagtcttctcctctcctccccatgacccacagggtctgtgtgaagagaggccgggctctgggacgttcagagaggaggattcagcgttttgttgctctgggacacagcttggtcactccgggaaacgaacacaacctagaggctgtcatttgtagaaacagcgaatggccaaggaatggcgggaggagggaaaaggaagacttttaaagaaaaaaaaaaaaagccctgaaagactggactagaaatcctcagggaggctgggcctgcaaggagccttcccgcgcctcagcccactttccttccctctcgacctgacggacttaaggcgtgcagagtctcttcggacaaaatgaagccaagagagccctaagcttctcccccagcaaccgctgcagaggcgggaaaacttgaattttgcaaccaagagttgcagcgggacgcctaagcaacgataaggggcggtggaggggcgtcgttgggggctgcagcatcccaaagtggaagcgggaagggggcccggctggaaccgaatagccccgcagcgcctcggcaaccggacgggcggcgcatccaatcccctggaccgtgcgtgtgactggcgcgcgctaagcggcgcgagccccggcggagccgggcaaccaggcgcgcgctcgcgcgtgcgcaaaaggcccacccagccgagcccttcttcaggtgcgctcgcgcttccggccggcctccccgcgtgccttcccggggcggaaactccagcacccgcgcatgcgccttctggctctccggcctgaagcggggcggagggccatggcttcaggtgatcccgcccctccctcgtagcgcaggaccaatcgtgcggtggtaggcggggttttgaggaggcagcccgcccacgcaccgcgcgaggcgtgtatcgattggttggcgccgcgggcgcaggtgcgcgctttctattgggtgtgggcggaacgcgagggattgcggcatcttcgggggctgcaggtgagcgcgcgcacgcgccgcggctgtggtccgctcgggtgcgcgcgcgcgggctcgcgggggaggcggcagagggagaggttgcggcgcttgtggcctccgctccgccccctcctctcctccagcgctgtcgccgtcgccgccggggcccggagggagggagctgcttccccgcctgccgcgccaccagtccgaccctcggtcccgccgtgtgagcagctggtggagtggagctcagcgcggacgccggagctgcggccgccccctctgcaggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaaggtgcgcggggcccgggctgggcggagcggcgggcctggggggccggggcctgggagaggccgggccaggctcggagcgccgggggaggcgacgggctgagctgccccggggtctggacggtgcggtcgggagactgtgggtaataaacttgccgaggagggggtggcgggggtcagggggcgctagtgtccgcccctggcccgggcaggaagaagacctagtccagcatttaatctcattccgtaaatctcattcccgtgttcacggacgggagtaggggccaaggtatatccaaggatggcgcacactgagtgaaatgcgaggctgctcaaaaggtgtaggagaatcctgcctgctgggctgtgagtaaagggccctggaccaccccgttgttcccactttctgtggttaaggggcgcatcgagtggcgaaggagagagcccagtgaactaaacagccctttaaaagttcgctttgcttcctgctggcgctctttctagcactaactttggtatgcatttaatctgtaaaattagtactatcaccttacgttggagtagcactttacagtttgactctagatgctcttttcattccatcctgctacctactcacatcaagtgcttttccccttgaccaacggtatgccaatctgctgataattacttcggtattcactgaatttctaaatctcaaggctcagtgagcagggtagtctgtagggagggattagttagggaatgccttccaaagggggttttgagctggaatttgaaggtgatcggcagccaagggaacactttcagcaagcgtttcttgagttgaagagttaaaaggagcttagataatctagcccaattctctgagaagactgaggcttagaaaggttatgacttcctcaagctgtttttttgcaaagccttcatgcctttttaataacttctagacattgcagaatacaaaacaggacactggctgggccctgagaacatttaaaatagaattgagaaggccaaaacacagaaaaggagaaaattgaaagtatatcaatttcaaaaaaaaaaagtaatggagcatcatagatggtaagactactaaggagtatgtaaaatcaaggagtgatttgagtgaggtacagtggagtaaggaaagcttcctagagcctctaggtagaatagttttattgtctagggttgataagcaaagttctgtaagtttctgtaactgagaatcacatcgagaaaatcgacattcgtttgtaacatcattaaaaaatgtgatttgagtctgggcgcggtggctcacgcctgtaaccccagcactttgggaggccgaggcgggtggatcacctgaggtcaggagtgccagaccagcctggccaacatgatgaaaccccatctctactaaaaatacaaaaaatttttagccggccgtggtggcacatgcctgtaatcccagctacttgagaggctgaggcaggagaatcgcttgaatccgggaggtggaggttgcagtgagccaagtttgcaccattgcactccagcctgggcaacaagagcaaaactccatctcaaaaaacaaaacaaaacaaaaacaaaaacggcttggcacttacatgaggattggcactagtttcagaattagtaagaaaagacgtgtagttacagcaatttaaggaatgtgcatgtccatgtgtcctctgtgcacagcatagcaaattgaagtgacttgcttgagctatagcgttaagatgacccaaaatacatagcagaacttttcctttagcggtatggtggcagtagaggttccatgcccagtggttgaaccttcttatggcatttttgttataagtttagtttggatttgtgggagttgaggttatggaaagaaaaacacttgtgatattgcataatcttaaaattttaagtttatagccctaatcttggtagcaagtctttaatttttttccacagaaaaaaatgagtaggaattctaagtatactgataaatacaatcaaatagtaatttatctctagtactaagaaaccttgagtgctttaaaactggaatttcaggctttttgcctttctcttgtcaactgatttgtgaatctttcacttacttctgtctaaactacatgttgtatatttgaactgccatactgcactttcagctaactgtgtcttttaaatagaatcatacactgattctaggaacatgtgctgaatgaagtcggtcccactattctagctgttgacaaataggcaagatataggtagtgagtgtttctagtatgtctatgacaccttatatgtttcaaatatatattgctgatacatttattttcagtagattgaaacatttgtcaccttaaccatttaaaaaatatttggaagggtttttgaaacagtattttctttgacattgctttagtgataccacagctttttacaaaactgattgctaagagtttataaccaaaactaggtagtgtgccggtccttttttttttgagacaggatcttgctctgtcacccgggctggagtacaatggcacgatcacggctcactgcagcctcaacctcctgagctcaagcgattctccgatttcagcctcctgagtagcaagactacaggcgtgcaccactacacccagcttatttatttatttatttatttatttattttgtagagatggggtctctccatgttgcccagtctgatcttgaacacctgagctctagtgatccgcccgtctctacctctcaaagtactgggactacaggcgtgagccactgcacctagctggtccatttttctcttactattttcaatttttttttatctttttagagacagggttttgccatgttggtcatgttggtctctaactcctgagctcaagtgatattcccacctaggcctcccaaagtgtttggattataggcattagccaccacactgggttccggtccatttttaggatctctttttcttcatataaacagtaatgttggccaggcatggtggctcacacctgtaatcctagcactttgggagggcaaggtgggcggatcacctgaggtcaggagttcaagaccagcctggccaacacggtgaaaccctgtatctactaaaaatataaaaattagtggggcgtgatggcatatgcctgtaatcccagctactccggaggctgatgcaggagaattgcttgaacctgggaggcggaggttgcagtgagccgagattgcgccactgcacttcagagcctgggtgacagagggagactctgtctcaaaaaaataaaaaaatgcaataaagcagtagtgtcaacattattatcttcacacgtggaagggaaaaatagtaatgataaaagaatggagaatgtaaatatacctatagttcaatttgtggtaccagctagtatgtgacttttctttggtaactgttttatcttcctaattgtatctctagtgttgggaagattcttaatcaataatcttgatgatgtcctttaataaccctggaacagtctttgagtcataaaatttcctaattattattcataggcaaatagactatgaaaattaagtttgcatttctagaatgtaccaacagacactgggggaagggagtccatacacattctggatggctagggcaaactaggctatgaaacagttgtaaatggttcacaagtgaataattgctgattgaatcttaattttgtctcttagtgtttttgttcatgtaaaaagttcccttaatcctattgttgtgttgcaagaagcataacaatttctcttgggtttttttttcccatgccaatattggcaaaagtgcaaatataccatgaagccatacaattttttattgtttttatcataacagttaagcaagagaaaatattgagcgaagaaatttcatccaaaagctttaacaaaaacattgaagccctaaaatgttaaatgatcagatgttattcccattcatacatcaggggaagtgataaaccctgtggatgaatcagcaagcactagcaacttcatgttgtgataccagaataaagaaaatggaggagaaactgtgacttttgataacatcatgagactaactgatatgaagggtgttccctgagtttttatttactttgaaatgtgaaggtgtgactaaactttttgagagccttaggtatgagtcaccttattttcttgacagatgttagtgtttatgtttcaggaatgtgttttgggaactattttaatttttgttagaggtaagaggtgtttttagtgagttttgatgttaaaaccactgaggagtatgggtgtaagcagagcaggtgaactttagatagagcaaaaccagtgaatccagatgtcccatgggacctttgggaaaatgaagtgacatatttgtaaactcaaattattatggtaggggctttctctacatgatgcttaaggctgtaccaacagtatttctcttttccttttttctctgggacataatatttttacattagtatttcttgctagtaatagataggtggaagaaatatgagttcagtggttaaacacattaggcaaacgttcgtttaaatatttttaaaaaccaacatagggcttaaatgagcctttaaagtgctggtctccgcagtgattcccaagagcataattatgtagcgtttctcaaacttacatgactgggacactttttgaggaaggcagattaacttttcttaggtttccacgtttgaggaaatgccatgttattcccacagtgttataaatcctgtttatcatggactagatgaagccagtccttagtgttttggttttttttttttttttcttttttgagacggagtcttgctctgttgcccaggctggagtacagtggcatgatctcgactcactgcaacctctgcctcccagattcaagagagtctcctgcctcagcctcctgagtagttgggactacaggcatgtgccaccacacctggctaatttttgtatttttagtagagacgggttttgccatgttggctaggctggttttgaactcctgaccttgtgatcctcccgcctcagcctctcaaagtgctgggattacagatgtgagccatcgcgcctggcctcagttcttagtgttgaataagagtcacttttaattatttgacattgggaaaacagaggtgtagggaaacagacttcagaatcagaactgtgaaggtaagtattgggcatgatggaggctgtcttcctccccattccgccccatttgtgtgatctcttaatacctccctgaagtaattattctctttacccactaattggtgagcttctggagcaggctcgaggctttcaatctctagggcctagcactgtgccaaacacataaacactttgtgcgttaattggatagttataggacatacatttgatgtattactgaagcttatttttttctgcattaacatagggaagatcataccttaacgccacgtagctcacagttctttttgtatattttgctgttgattcttaccacataccatgaaatcctagttccatttatgggggaggacacttaaatgctttcctttggtcaaaataaggacttggacaagtctttggtaccccatgatgcacctgaggagagcattgccgtcagagtctgggctccagacagggtttgagctgagtcactatgcagaacagtccgcagtaaggcctaggtaccccagggatagatagagttgagcctgcctctcttgaaaggaatgctcttcagagacacagcagtcaggaggcacattcttgtgcctttcttaggctttttaaaatccctgatagtaaggttcttcacaatagacaatctttccttaattaaaaatacttgctctgctcgttaatttttctatggcatgcattttcaaattgggtccttttacttttttttttttttttaagtaatatgtttgttacgtttatagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaagggtaagtatcactgtttagaaaaattgtgttagaaatagaaatagtgtattttccccactgaaaggatacccagactttgccacaaacttagtgaataaacattttgtgtgaatcttcttatgttaactaacatgtgggttaaaacatttgtgatattgttggtttaattaatatctttatgcttcactaagtgtactttagaaaatttatatttctagttacttttgtgttaacctctttggttttatttttccttaagtagaaattgggaatttattgaatattgggaatttattgaatcttcactttatcaaatggattattctccactcagaaaaatgtgaaaagagtgtgactttggaatccaaagcattcctgttttttggtggcaaccaactttcaaaggctgtatttaccagttaataaataccagaaacaaagccatttaatcttcctgagtctcaatgtctgcacctatagaaagattataatattttgtagaattactatgaggattaaatgagctaagtgcagtgccctggcttatagtaagcacccagtaaatactttctttcttttacttttaggatactttttaaagaaattgtataaaactagttaattatctggaaaatgaggtgggaagttactattgtggaaggatgtaaacactgatattaattagtcttccaaaaaaattgaaatcactatttggcaataactttctttctttctttttttgtaaagactgggtcttactatgttgcctggtctccggtgatcctccagtccctgcctctcaaagtgctgggattataggcatgagccaccatgctcagccaagaattttcaaatgtattttgagtcctaaaactttttttttttaatctcgtagcctttgtgtgtgtatgtatgtgtgtctgcagataggcagggtagggcttattatggtatgtaccattttttcctttctcaattgtaaatgaagtggtttgggaagccagcatgagagcatcaagcctggtattgggataaattaaagacttacggtatttataagccaacccagaaagtagcttgagagcggccaggcttggtggctcacgtgtgtaatcccagcactttgggaggtggaggcgggcggatcatctgaggtcagaagttcatgactagcatggctaacatggtgaaaccccatctctactaaaaatacaaaaattagctgggcatggtggcacatgtctgtaatcccagctattcaggaggctgaggcaggagaatcagccaggaggtggaggttgcagtgagccgagatcgtaccactgcactccagcctgggcaacagagcaagactcctcaaaaaaatttttttgaaaagaaagtagcttgagagaatgggtggggattatctttgaaggtgaaaactatttctaatcagttgataagcattagaccactcccagggctctggaattccactgattatgtatctttgctttcctgggtttggaggaactaaagtccaccaacaaaataaacctccaaggataacctctgcctatatcacttgactattttacaaaatactttcacacacaaattaatgttcccaaagtttcctgagatggatctcaaaggtaattaacaggaatgcgatataatgagagtatgaccttaggaagattcagttggctgttcaggatgaattggagtgggcagcagtcttacagtagagagccaggagcaggcggtaaagaagtgaggagactggcctagaagtagaggggaagggtggggggaggggagaaggcagtggcgggaaggtaggaggggaaatacttgggagtcattgcactcactgtggctgctttgcagtgaaggagagtccagcagagcatatcttgatggtttgagtctgacagctgggacagtgtcatgaacaagcagagtagattgatttggaaaagaaaattatgaattttgtcttaggacaaataatcttaaccagtcattcagaagattagaaatggtagacaaaagttcagggtagaaatccaaaaactagttagatttgcaagctttttgaaaagtgatagttaaaattttgggagtagacataaaggctatctgagatgaagaccatggatagaaccttggaaagctatatatagagtgctggaaaaggaggaagaatttaaataattatggttgaataataggcctttcttgttagcaattgtaattttctttaaaaagttagttgctgtttggatgtgcattcaaatatagagtgggtttttaaagtattgccatgtgacagaattttgttggattatcccctttggtagaaagattatgacagttgagttataccaccacatgttttgttaatggaattatactcttgcatgattatggaattaatcctaacatcttttaagggtagttatcttttatttcctttctaagtttttatttattggtggtataatttttattgagacctttgatggtttttattgttgtcataggaattacaacttagaaatatgtttctatgtgcaaatgttttctatttattaatggtaaaatgtccaatataattgatagcccttagaatttgatttagaaataggcaattcaacagaaatattttagattttaaaaatataaatttaatacaaatatgactttagcaaaaatgaaagtaggtagtcagttcattcctgcttaaaaccctctgatgatttcccattgcaaccagaataaaatcccttctgatttggacttcccaacctcatcttccctcattctctcactccctcatcacagtcagccacactggcttccttcctgttcctcagacttgatgagcttgtttctttttttttttttttttgagatggagtcttgctctgtcacccaggctggagtgcagtggtgcaatctcggctcactgcaacctctgcttcccaggttcaagtgattgtcctgcctcagcctcctgagtagctgagactacaggtgcatgccaccatgcctggctaatttttgtatttttagtagagatggggtgtcaccatgttggccaggctggtctcgaactcctgacctcaggtgatccacccgtcttggcctcgaagtgttctgggattacaggtgtgagccactgcacccagccgttagcttgtttctgtttctgtgctcttatgcttggttattcttaaggacacttcaccctcggttcttcccacgtctgcctcctcctgcttagctcagataagtttgtcagaggagtctcttctgactaccctaactaaagccctccaccttcccacctttaccacatcatcctctgaagacctggaaatatcttatttaagaatatgttaacttgtttcctgtctgtctggtttaccatcaggtcgcagcatctaaatctggcagacttacttagtgtactataatgcatgcactcttttttttgtggagtggggacggagtctagctctgtcccccaggctggagtgcagtggcgcgatctcggctcactgcaagctccacaccattctcctgcctcagcctctgagtagctgggactacaggagcccgccaacacacccggctaatttttttttttgtattgttagtagagacgggatttcactgtgttagccaggatggtctcgatctcctgacttcgtgatccgcccgtctcggcctcccaaagtgctgggattacaggcgtgagccaccgcgcccggccgcactctgtcttttaagcaaagttgagcagatgcttaactagaaatctgattttatgtaaaccttaatgaacatttaattcaaggaactaatataaagtatgacattaagtatagttacattttactgcttgattacagcacattttctgtttgctttttgatttcagttaggcatcagtaaggcagaagttacacttaatatgtactggtgttttgttttgttttgttttaagtcttgctctgtcacccaggctggaatgcaggggcgtgacctccactcactgcaacctccgcctcccaggttcttgtgcctcagcttccagagtggctgggactacagatgcgtgccaccacgcccagctaatttttgtatttttagtagagacagggttttgccatgttggccagactgttctcaaactcctgacctcaagtgatccgcccacctcggcctcccaaagtgctgggtttacaggtgggagccgccgtgcctggccccaagtgatttattttattttattttattttattttttttgagacagagtcttactctgttgcccaggctagagtgcagtggtgtgatctcggctcactgcagcctctacctcctgggctcaagcgattctcctgcctcagtctcccaagtagctgggactacaagcgtgtgctaccatgcccggctaatttttgtgttttcagtagagacacggtttcacgacgttagccaggctggtctcaaactcctgacctcaggtgatccaccctcctcagcctctcatagtgctgggattacaggtgtgagccactgcgcctggcccccaagtgatttttgaaaagcaaattgcaaaaccattttaaaatttaaaactatgtgatcttttaacatctgatactctactaaaatttctttaaagtgaaagcttacaattcaatgtgtaaactactttatagtctgaagtttaagatagtgttgttggatatcttgaaaaatttttataacaatttattgttagaagaaaaaccccatactctattcctagagcagttatcatgggagcaaaaacaaagcacaagaaacctggtatcttaaaagttattttcatgcagaggatcccaatcccccattccctgttaagagtattagagtttatcctaattgattcgggagatggggaagagaaggtacagaatagactttctgctctcattgttgaggttattgctgtgcactaaaaatttttaaaaaaatatttaaagcttgcgccttttaaaaatactcaggtcattcctgtcagtttggaattcagccagggaaatgtgtatttttaaaagcttcccagccagtcctgataatcagccaggtggaggatctgttgatgtgctacagaacagacccctctccagatctagtcagaatctctacatccagacttcttgctataacaccgtctgtttttgattgacaccagacacatatgtttacctcttcgatttattctcgttttattaggaacactagaaaggctttgctttaaactttgtctctcatagggcatgcccttacacagatgtgactttgtggcccagatgctggtaactgggcatctaaatcatctcttagattttgtgcattggacattattttgtaggtgtcttttaaggttacatttttatgaatcagggtttaaagttgtctaaggaatatacattttagtagtaaattgtaaattatagttttaacaaaagatatggcccagaaatgaaaaaaataaattacagcctgtaatcccagcatttttggtggccgaggcgggcgaatcacaagatcaggagatcgagaccatcctggctagcatggtgaaaccgtgtctctactaaaaatacaaaaaaattagccgggcttggtggtgggcgcctgtagtcccagctactcggaaggctgaggcaggagaatggcatgaacccaggaggcggagcttgcagtgagcctagatcgcgccactgcactccagcctgggcgacagagcgagactccgtctcaaaaaaaaaaaaaaaaagaaattgtggagtaacatctcagtatgtgacaccagttactcacaacagaaacgtgggtgtcacctttgacacatacctattttttagtcagtcaccaagcctattaaaactgtgttctagttatttttcagatttgtctccccatttccatgtcctctgctccaggccaggtgccatccaaatttactgaagtagcttcttttttttttttttttttttttttctgagaagcagtctcgctcttgttgcccaggctggagtgcaatggcgtgatctcgtctcacggcaacctccgcctcctgggttcaagtgagtctcctgcctcatcctcccgagtaggtgggattacaggcatgcgccaccatgcctggctaattgtgtatttttagtagagatggggtttctccatgttggtcaggctgcttgcgaactcccgacctctggtaatccgcccacctcggcctgccaaagtgctgggattacaagtgtgacccactgcactgcgctggctgcagtagcttcttgtcctccccctccacgtccttctccagcctgcagccggagtgagctttgtagaaaaaccaaatgagttcactatcactgtcttcccttaaaatccttgattttcttccctttgcccttaggctaaagtctgtaaactttggtacttcccaggaggccctgtttgtctgtttggcccctggctgcctctgactcagctcctgactccctccctccctccctccctcctgcttttcaccctctgttctagctgtattggatttctttgtctggccctccctcttctggatattgtcgagtcctgtgcctggaacattcttcttgccttctactattagcccctggctggttttcctcacagaatcacttccctggagaagccttgccttactcctacaagccaggccaggtcccctttacatacttccccagcatggtgtgcttatagctctcagcacctttgttataatttacttagagtatttgaaattatttgttagttgccatctcctcttttagattgtaagcaccacgaaagtagacaccatacctattttattcaccaaatctgtaccacagagcacaattcctggcacatagtcagtgttcgttaaatatttggtgattaatttttctgtattaggaatgaaggggtctgcaaaatttgaatatctaatttgctttaagtgatatttaatctttttaaagttgccagatctggctgggcgcagtggctcacgcctgtaatcccagcactttgggaggccaaggtgggcggatcgcccaacgtcaggagttcgccaccagcctgaccaacatggtgaaaccctgtctctaatacaaaaattagccgggcatggtggtgcatgcttgtaatcccagctactcgggaggctgaggaaggagaatcgcttgaacccaggaggtggaggttgcagtgagccgagatcgtgtcattgcactctagagcgaaactccgtctcaaaaaaaaaaaaaaaagttgccagatctatctcatttaaccattttatattagagcaagagttggcaaactaaggcctgttggctgcttttgcatataaaattttcttggaacagggtctcaccattgcccagattggagtgcagtggtgccatcttagcgtacttcagcttcgacctctcaggctcaagtgatcctcccacttcagcctcccaagtagcttggactacaggcacaaacaaaccaccatgcccagctaatttttaaaattatttttgtagagacagggtcctgctatgttacccaggctggtcttaaactactaagctgaagcagtcctctcacctcgcccttccaaagtgctgggattacaggcatgagccatcatgcctggccacataatattttatggattgtctgtggctgcttttacaagagtgattatatagcctgtaatacctagacatttactgtctgactcttgacagaaaacggttgtcaacccctggattagaacattttaaaacattatttcattatttgatttcttcctctgatcttcaagtggggcataatcttgaactttgttgatggctgtactataatggttgctgttttgttactgtatggggatactgatggagcttatgtagaagtttttttttttttctagatttgctttttactcactgtgaagcttttatgtcttacatctgcctgccacccacaaatggatccttaccctttgctctgaatgtgtggtttatgaccctctatgagcaaaggaatgagattactaggcttttcagaattaatgtttaaagagtaagaggttcagagggaagccctgcaggataagtgaagaacagccactatttgtgtgtaagaaagtaagacatccagtttgactatttggaggccttctaggtggatccttgtctgttcagttagccgagatcattggctgaagaaaaggcttgggataaatgcggtgctgctgtatcagcccatatcatgtactgttgcataagtgaatttatacaagtggacagttgctatgatcaagttttcaaactttccatctcattctgagtttaatgctctgatagtgttcaggtagaaagtcaactccaattccttgtggacattcacctttacactttaacaccctgaaccctggctttctgccaaaatattttctttcccagtggctggaaactgattagctagatgggagaacaaaggtggctttgtactggggcatattgcttttgagaatttagcagagagcattcaaatggagtctggatgtgatgccaaattatgcagatttggagtttattttggttaggtttcccatgagtaggtatgtaggcaacgtaatactgttctcagtttatatggtctggaatttcccttataaatgttatataggctttccttattgattgttttaaaacacaaatatgtatgattttgagaaaacacattaccagaagactattcttgataggtttttttgccaaaaagattgttgtaccaatggatttatatccaaagccatattataaatacatttctgtctctgtaagagcccaatgcaaatacttataaatgattacaagtgtccccaaggggaaaaaaatgccaaaaaaataagatacccgtaaccttatatatttatctgaaactaggttttgaagagtgttcacgcagcatcagaaaagaatactaaagctccccatactctgacataattgatacttggcattcattattgtgacttggaagatactagcctcgtaagaaaacctgggctctagttctttctgtgtaacttacgttgtacccttaatttattggttataaagtgaagatgataatagtttagcaatgagggggtttaggattaaacaagagaatatgagttgaagcgctatacaaacgcaagatggtgagattggtgttttctgtggcagcagctgagactaggattttcaactattttgtggaggaggagggaagccatttattttttgttgttgtcttttcttttctttttctttttttctttctttctttttttttttttttttttttttgcctagccactggaaaaccagggagaggcattattgaagttgttgtgttttttttttaattcatgtaaatttcactttttagtttatcctcattgtagttatttttgaaaatactattttaacttttgtttctgctgttagtttcattttctgttttacctctcattctctgatgaaatgttttgtttatagactatcttccttcagccatataatttaaccatatctggtgttaggtgttctgttttcccttttagtttattatttaattaggcggcagtatttaaagatcgcaagattttgcctaaaaacaagactttctggcatgaagaaaatctgcgaggaactgagaagcagctatgccatctaaatgaggcaggagctctccagtttgccagagtcctactacttcctattgtctgtgtcaccaccactgaggacaaaataccattgaactttatgcatagtttttcacacagtaaagaaaaaagttaaaactccacctttgcctctttcaaaatgaaaatgagagatcaagaattcctgctgggcgaggtggctcacacctgtaatcccagcactttgggaagctgaggcaggtggatcacctgaggtcaagagttccatcaagaccagcctggccaacatagtgaaaccgcatctctactgaaaatacaaaaattatctgggcatagtggcgcatgcctgtaatcccaagccacttgggaggctaaggcaggagaatcgcttgaacctgggaggcgggggtggcagtgagctgagatcatgcctctgcactccagccaggacgacagagcgagactccgtctcaaacaatagcaacagaaaactgagggagagtgtttatttgcagaataccaaaattccgaagtgtttgtttgatatgcatcagcatcaattacattatctgcccactcagcctctgatattggtatatgattttactctctgatttaccttgagaatcaaatatcccacttcaagtatttgagttgaatatgataaacatgcaaattgcaggcgtgtttttgttttgttaccgaggctggagtgcagtgatcatagtgcgctgcagacctgaatcctggagtgaagccatcctcccatctcagcctcccaagtagccgggactccaggcagacgctacctaccacacctggctaatttttttttacttttcataaagacagggtctcacgctgttgcccaggctgggctcaagtgatccactcaccatggcctcccaaaaaagcactgggattatagacgtgaggcaccacgcccaaccacattacaagttttttaaacaagtgaaggaaaaatgtattttaagtaactggtttaaaatgatgttttaaggccggacacagtagctctcacctgtactcctagcacattgagaggctgaggcgggaggatctcctgaggccaggagttcaaaaccagcctgggcaacatagcaagaccctattcaaaaaaaagtaaaaatacatatatatttaatgatgtttaagaatatgtaagatctggccaggtgcggtggctcacgcctataattccagcactttgggaggccgaggtgggtggatcatgaggtcaggaaatcgagaccatcctggctaacacggtgaaaccccatctgtactaaaaatacaaaaagttagccaggcctggtggcacacacctgtagtcccagctactcgggagggtgaggcaggagaattgcttgaacccgggaggcggaggttgcagtgagccgaggtcacgccactgcactccagcctggtcgacagagcgagactccatctcaaaaaaaaaaaaaatatgtaagatctatcatagtttcatttgccatatttaatgtttaaaagtgaatgagctctatcaaatttaacttcaacattggtttattttgtgatgtgtatttgagatggccacctagtggttttttctggtatggcattttactactgtactagattatgatctgattagaataagcttattagctagtttgtttatataccaaatatattttgagttatcctttctgtacagattcagctgcaagtgaatagatatttttacagcatttctataattattttgttttatttttaaacagaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatgaaaccgtggtttgaatgttttcagagtgaggatgccatgaggacttgtacatttggctagtttaaaagcatatatacctctgaccagtgacgtggaataggcatgagacgagtaacgttgcaagcttacaatattattaaagtagtagtttgataattgttaatataaactttggtggatcagaggtgaatttaagtccaaaacaaaggggcctttgctgatgaagttacgtgcttttgctgttttgtctgtggagaatcagatgttaaagcacattcttggaactatgtgagaagactagatcatttctgttggaagtggttgcatatttaacctgctgtgcagagcccagttaatttttcctttaactgtatttttaaaattctaatgtgaagtctgattctctcttgtggtacattggggacctcagctcttaaaggtctcatgttcccaatattttattttgattttttttttttttttttttttttttttttttagtgactgggtctcactctgttgcccacactggaatgcagtggcatgatcacagctctctgcagcctcaatcccctgggctcaagcagtcctcccacctcagcctcctgagtagctgggaccataggcacataccaccacatctgtctactttttgtattttttgtagagacagggtttcgccatgttgcccaagttggtcttgaactcctgggcttaagcagtcctgcctcggcttcccaaaatgctaggattagagccaccatgcccagcctattttgatttttgtttttttatgttcctttctaataaattgtaacaaatgatgttctcaagtacatttccagtttcttttcttttctttctttttttttttttttttttttttgagatggagtctcgctctatcgcccaggctggagtgcagtggcgcgatcttggctcactgcaagctctacctcctgggttcacaccattctcctgcctcagcctcccaagtagctgggactacaggcgcctgccaccatgcctggctaatttttagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgagacagagtctctgtcacccaggctggagtgcagtggtgcaatctcagctcccgggttcaagcaattctcctgcctcagccttctgagtagctaagattacaggtgtgcgccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatgctatttttaatggcattccggctttaacattctgtgagtcttacaaatttgactcttgaatggcaaaataatgttagtatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaatcaattatttcaagtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggctactttcttgtttgaaattatatgaaaagttgcccacaaataccaggtgcccattatataaaataggtagggagaaaacccttgagttttaacaagatccttgcttccttaacttttaattgttaaaagatggaccccaaattgtatgtgcactttttgcaactgtgtatgaccatatggctatgggctggatggtaacttttaaaatgtggttaattctgatagtgtgaaaggttatgcaagctattcacccaaagttatctttaagattatttgaaactagtttgtaatgtgacagcttatcttctgaaattcaaattcacttagttatacttaattaatattaccatctatctagtatggcctatgttgattgaattcaatttatactgaaaaacttaaaatgtctgagaaaaaggccaggcatggtggctcatgcctgtaatcccagcactttgggagtctgaggcaggcggatcatgaggtcaggagttggagaccagcctggccaacatagtgaaaccctgtctctactaaaaataaaaaaaaaattagctgagcttggtggcgcacacctgtagtcccagctacttgggaggctgaggcaggagaatcgcttgaaccggggaggcgagggttttggtgagctaggatcacgccactgcactccagcctgggcaacagggtgagactccatctcaaaaaaagaaaaaaaaaggtctgagagaaagaacaacctttcctgagccatttctaattccaaattagccaccctgtcatcagcttagttggtcattgcactaactcttctgccaacaagtttagaggacaataggacaatcctaattccttccctccaagttaaaaacactaaaaatcccgagtataaatggaacatcgtgcacacagaactcttcacacctttgattgggttgcattcagtacccgatattcatctctgggttttgagtccgtgaaacaatggtgcagaattaaaacatccctttcattcccaaaaaatgaccccaatgcaatttgcatctttgttttttttctttttttgagatggagtctcactctgttgcccaggctggagtgcagtggcactatctcggctcactgcaagctccgcctcccaggttctcgccattctcctgcctcagcctcccgagaagctgggactacaggcgcccgccaccacgccctgctaattttgtttgtatttttagtagagacggggtttcaccgtgttagccaggatagccaggatggtctcgatctcctgacctcgtgatccgcccgtcttggcctcccaaagtgctgggattacaggcgtgagccaccgcgcccagccttgcaatttgcatcttaaatcactgttgcttcctagtttccagtgctgagtaagagcttgattaaatttgattttgaggaaaaactaaagttacaaaaatttaccaaaaaccagacctctctgttctgcctttaggtgctcaagtgtttaacagcaactgacagaaccacttctgattgtgtttcccttcttttagtttgatgtggggtttaaattggaagtatgtataccagcgacttggcagctgagttctaagcacagttttgggagtgttttgctgttaaacatggaaagcctttgtttttatcttgtgatggcatatcacgtgatgatgatggctgttatctgtagggtaaagcaaaacccagtgcctcctagctatgatcacataacatgctaaatacttaagtactctcagaaaagatattttggaaaccaaaataagtcttcattgcccaaacgaagtatatgtgcagtcaaatgactgtcattgggtggataactgggcattagaaggtaaatataaaggaaattaatcggttaaaagatccttaatgccgggcgtggtggctcacgcctgtaatcccagcactttgggaggccgaggcgggcggatcacgaggtcaggagatcaagaccatcctggctaacacggtgaaaccccgtctctactaaaaacacacacacaaaaatattagccgggcatggtggcgggcgcctgtagtcccagctactcgggaggctgaggcaggagaatggcgtgaacctgggtggcggagcttgcagtgagccgagatcgcgccactgcaccccagcctgggtgacaaagtgagactccatctcagaaaaaaaaaagatccttaatatgtctaccaaattcttccctaaaaacaagacttagataatattttaaaagctaatgtgtttatccagttgctttacaacacaattgtattttataagttaatattaaaattcaatggagtttgtattttatttacaaactataggtgtttttccacttataaaagctctcttttgggaattaagtttactctgaaagcagtattctctgtgtaatagaaaataaagaaaatttaatacccttattatctagttcattataatcccaagggatggataacaagataatacagcataagtaaagataactttttaaaaataattttcagtcatataaataatgtgcaaattcgttctccatatttaaaaaaaagtacagaaaaagctaaagtcttttggcagtaccatgcacatttatccataccatattctgttacaaaaaggaattgtggcttaaaataagagtgactataatttataatccaaattgggacacttttgagaatgaatgggtttgccacgaactatgccagtagaacaggctcggaccagatctgtctcaggtagactgcaatatgggtcaccctgttatagggtctctcaaaattttttttaaaaaactgcaatacacagtaagaaatgcattgaacactataatccaggacacacacactatgttttcatacagtaatgaaaaatgctctgattttctatttcacttttgtaggatgtgtattggaacattccaaaaacaatgtcaggatgccctgtttgaaaacactgtgaagtgctttacttttcacttgagatatttgccatgggaaagactatcatatttttccctaaaggagaataaaggtactgtattatctgcttgctagcttttttgtttgtttgtttgttttgaaataatttccaacgtagaaaagagctgcatgaaaagcataacctttgtccaggttatatcctcatttgctatctgtgtattttttcctgaaccacttcagaattagttaaagagattctccccttttatcccctttagacttaggcatatattttctaagaacaaggacattctcttatattttttcttatacaaccccaattatcaaattcaaaaaagttaacattgctacaatattatctaatatataagcaatactagaatctcatcaattgacctagtgatgtcctttacagaaattttttccttttatccaggatccaacccagaataagacattgagttgtctcatctcttttggcccctttaatctggagcagttcttcagcttttctttgcctttcataatattgacatttctgaacagtaaagataaattgtttcatagactgtccctcagttggggtttatctgtttcctcataattagattcaagtggctgggcgtggtggttcacacctgtaatcccagcactttgggaggccggggcgggtggatcacttgaggtcgggagttgaaaagcctgcccaacatggtgaaaccccatctctactaaaaatacaaaaaatttagttgggcttggtggtggacatctgtaatcccagctactcgggaggctggggcaggagaatcacttgaacccgggaggcggagattgcagtgagccaggatcacaccactgcactccagcctggatgacagagcaagactccatctcaaagaaaaaaaaaaaatagatttaagttatgcgtttttatcaggaatattacataggtgatgttatatctttatttcaccatgtcaacaggtacatcatatcagtttgattcaatattggtttatcaagtgagaagtgatttggaaaaaataaaataaaatatattgccaggtctggtggctcatgcttgtaaccccagcacttcgggaggctgaggtggaaggatcatttgagcctagaagttcgagagcagcctgggcaacatagggagaccccgtctctacaaaaaatacaaaaactagctgggcatggtggcatgcacctgtggtcccagctactgaggaggctgaggtgggaggatcgcttgggcccaggaggtcgaggctacagtgagctgtgagctatgagtgccactgcactccagcctgggtgacagagaaagccctgtctcaaaaaataaatgagatgttctaattattcttgtgctcattaaaaacgtgaatggagccaggtacagtgactcacacctgtaatcctagcactttgggaggctgaggggggcagatcacttgaggtcaggagttccagaccagcctggccaacacggcgaaaccctgtctctacttaaaatagaaaaattagctgggttgtggtggcagccctctgtaatcccagctactcaagaggctgaggtaggagaattgcttgaacccaggatgtggaggttgcagtgagccgagatcgtgccaccgcactccagcctggatgacagagctagattctgtctcaaaaaaaaaaaagaaaaagaaaaagaaaacctgaatggatccagatgaaagacatgtgttttctatatccatgtgttccgcatctttgattgttttccttttgaagaaacaatagaaaatggtgacctggcaccagtattctcgaatgtcctttgcttaaccacatttctgaactcagtaatgactttctctggcattggtctgaatgaaaagaaagcacccaaatgatacctaaatctgtgactaatggggctggtcagtagtcagagtgttcagagtgggaggatgttgccttgggattctttggcttgtgaatacacctaactccaattgacgtctaacttagattcaaaggaatggattggctcgtgtaactgaaaaatcagggctaagatttcagcacagatcggacacagtgccatctgatagaattttctgctttgtccagaggggagtcactagcccccatgtggctgctgcatacttgaggtgtggctagtgcaactgagaaactggatttcaaattacatgtcattttaattaatttaaatgttaatagccacatgtagacagtggctactgtattattttacagcacaaactggaatccctctccatttcttgcttttgttttcccctgttaccttttttcccttaggccaagtccctccttatggtggcaaagatggcctccagcaaccctggcaacattccgtcacattaccaaccacctggcagggagcctgtcttcccccatggtgacagccaaagcccagagaccaccctcactgaccctgtctcagtcatgtgcccatccctaacccaatccctataactcctaattgtcctagtctgggtcatgggcccaattctggacctattgagggagggatggtcccctaaagaaaaatcagggatcagccaggtgcagtggctcacgcttataatcccggcactttgggaggctgaggcaggtggatcacctgaggtcaggggtttgagaccagcctggccaatatggtgaaatcctgtctctactaaaaatacaaaaattagtcaggcatggtggcggacgcctgtaatccgaactacttgggatgctgagggaggagaatcgtttgaacccgggaggcagagtttgcagtgagccgagattgcagcactgccctacagcctgggcaacaagagcaaaactccatctcaaaaaaaaaaaaaaaaaaaaatcagggatcagggttctgttaccacaagaaagaggaagaactacaggggagggaacacagtgggtatcacttgcagctttttttcttttttcttcgctctgttaccaggctgaagtatagtggtgcaatcataactcactgcagcctcaaactcctgggctcaagcaatcctcccacctcagcctcctgagtatctgggactatggatgcgtgccgccacactcagctaatatttttcggagagacagggtctcactatgttgcctgggctagtctcgaactcctggcctcaagcaatgctcctgctgccttgtagatttagagtatttgggaacacattttttataaaatgtcctgcacaaagtaaattggggacagagagcagtgctctatcaaaggaaaatggtggaaattaaatacagagaccagtggcagtgttctacctttaaaggaaaaacttaaaactcctgacagcgactatactaggacttctgttttcaagtgttattgcttattttgattctattttaaatacatctgctgagatgggcagatcacttgagcccaggagtttgagcaacatagcaagacctcatctctacaaaaaatttcttaaattagccaggcatggtggtgcacacctgtagtcccagctactcaggaggctgactgagacaggaggattgcttgagccttggagtttgaggctgcagtgagctatgatcatgccactgcaatccagcctgggccagagcaagatttgtctctaaaaaacagaaaagaaaagaaaagaaaaaaatatatatatatgaaataaatctgacataaattgaatatataaagaatatataaatgcaatataaacttcaatctgaaatggcagtttcaaatcctattactttcaaagtatagaaatgataggaccatgggtctcagagaggaggttgcaaattcaaatgcccaaagggccagagtggggcagggcaggtggggctggtaaacaggagatgcccgcccccagcaaggcaggggccaccacattcgatggttgtcatttgggtatgtgtgggcccagtgttgtcagctcttataacttttttttttttttttttgagactgagttttgctcttgttgcccaggctggagtgcaatggcacaatcttggctcaccgcaacctctgcctcccagcttcaagcgattctcctgcctcagcctcccaagtagctgggattacaggcatctgcaaccatgcccggctaattttttgtatttttagtagagatggaatttcaccatgttggccaggctggtcttgaactcctgacctgaggtgatccacctgcctcagcctaccaaagtgctgggattacaggcgtgagccaccacgcccggccctgcttatccagattttcataagaaatgtccttttttttttttttttttttttttgagacggagtctcgttcttctgccctggctggagtgcagtggcaagatcttgggctcactgcaacctctgcctcctgggttcaagcacttctcctgcctcagcctcccgagtagctgggactacaggcacgtgccaccacgcccagctaatttttgtatttttagtagagacgggctttcaccatgttggccaggatggtctcaatctcttgatctcgtgatccgtccacctcggcctcccaaagtgctgggattacaggcatgagccaccgctcctggccgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgctaggttatctaccagaagaaaggacaagaaaggctagaatttgactaatggttccaccccccagattgtatcagcacagcattcctctttcactcagtctcttagcaatgcttgcaactacaaggaaacagcattcataccattgtttctaagacctgaagcaggttacattcaaacccagcactgttcttatagaacataagagttttgttcccaggctgcttctctgccagcatgtgatacccttcaataaatggtaggtaagttgcatatcaggttttctcctgcattcccagagggcttcagctgctgtctcaggtatgaacccaaaatgactcaggcaaaaatgtgtatgcttagtgactcagaaactaaatcattaacttggtaagtacatgcacgggtaaggaggaattcaaggagagacttagaacataggccttccagtaatgccactgatgatgactgcctgagtacagcaacgctgaacggtgtcacttctcaggtggaccagtgacgaaccctagaatcaccaagaatctcaaatcagtcattctcaggagcaacaatccacatagggtaatttacaaagaatgctgatttcaattgtttgaatccttacctggtgaaacaagaaaatgtggaaaaagctccttgactttaaaaatacacacccacacacttttttttttttaaagggacaagggcttgccgtctcccacacaggctcgtgggcggtggtgcgatcatggctcactgcaacctcgaactcaaggattctggcaatcctcccacctcagcttcccaagtagctgggactacaggcatgagccatcacacccggctaattttctttttttcttttcttcccctcaccccaatttttttttttttttttttgagataaggtcctgctctgtcgcccaggctggagtgcagtggtgtgattatggctcactgcagcctcaaactcctgagtccaagtgacctcacaccttagcctcctgagtagctgggactacaggtatgtgtcaccacgcctggctaatttttgtattttttgtaaaggtgaggtttcactatgttgcccagtctggtctcaaactcctgggctcaagcaatctgcctggctcagcctcccaaaagtgctgggattacaggcgtgagtcactgtgcctggcctccacatgactttctactagttgattttaaactgggcatatgcatttacacacacacacacacacacacacacacacctgatctgcctagatgtgaaattaaacttctagagcacacgcatatacacaacgccagacaatatgggaacagtgattacaaacaaatcccactagaaaatgacaaactgtaataatttttcagtccccttttgaaggcaagaggtttataaacctctgcaattcaattgcaacacatcagggttcttctggtgagctggcctcagtgtccttcctccacccccagggtgccttggctcatgttcacagggcccatgcccagtagggctggcatgtgtttccaacagccgagcagacagggccagcagagagggagaaaataaacggtaaagggagacgcgccaggagagcaggcagaatggccgggaagctggccaaacgggagaggctgaatgggcgacatcagcccttgaccaggcctcagctatcccagctgtccttcaccactcactgtgtggataccaggaggatacaagccccctttgcctgggcgtcaccaagaatccataaaccacgcagtttatttttatttttatttaattttatttttttagatagtctcactctgtcgcccaggctggagtgcactggcgtgaccttggctcattgcagcgtccacctcctgggctcaagtgattctcgcgcctcagtctcccaagtagctgggattacaggcacctgccaccacacccggctaatttttgtatttttagtagagatggggtttcaccatgttggccaggctggtctcaaactcctgtgctcaagcaatccactcacctcagcctcccaaagtgctggaattagaggcgtgagccactgtgcctggcctatttttattttttgaaatagtcttgctttgtcacccaggctgggtgcagcacaaataacacggctcattgcagcctcgacctcctgcgctcaagcgatctttcctcctcagcctactgagtagccgtgtgccacaggcatgtgccaccctgcctggctaatttttttttttttttttggagatggagtcttactctgttgcccaggctggaatgcagtggcactatctcagatcactgcaacctccgcctcttaggttcaagcaattctctgtctcagcctcccgagtaactgggattacaggcgcatgccaccacgcctgactaatttttgtatttttagtagagacggggtttcgtcttgttggtcaggctggttttgaactcctgacctcaggtgatccaccagccttggcctcccaaagtgctgggattacaggtatgagtcaccgtgcccggccgcctggttaatttttaaattttttgtagagaccaggtctcaccatgttgcctatgctggtcttgaactcctgcgctcaagcttcccaaaaggctaggattacaggcttaagccacggtgcctgcccatgtggtttttagaccagcaggttctgtagagcaaaatgttcatgattttgaaggatgacaaacctgacagaggaggcaacgccaccttgacattcctcagtcgtagtgccacagtggtctcgtatttcaaacctggttagagtttgtcctcttcaggagagtttgtgtggctgttttgcagtggaggagagatgacaaagctgataatgcttatggtgtgggtattttctttttctttccttatttgctttgtgaagacaaataatggttaaggatagataaaattaaccgggtgtggtggtgcatgcctgtaatcctagctactcaagaggctgaggcaggagaatcgctagaacctgggaggcggaggttgcagtgagccgagatcgcgccattgcactccagcctgggtgacagagcgagactcagtctcaaaaaaaaggatggataaaatatttaacagtggtcatacataattcattcctgagtcgacacccatttccaggccagcagttcgctctcaattaggggttctcagaacacggaaccaccgtgtctccttggtagactgccattgtgcttatttttactcttttcttcctaaggctaattgtttttaccttttccttgttgagtactcattcctagatgtttttatcaaaggcaacaaaaataaaaattataggcaggactttttttgtttgtacgttttttgagacgaagtctcgctctgtcgcccaggctggagtgcagtggcgccatctcggctcactgcaacctccacctcccgggttcaaacagttctctgcctcagcctcccaagtagctgggactactacaggtgcccaccaccatgcccggctaattttttttttttttttttagatggagtttcactcttattgcccaggctggagtgcaatggcacaatcttggctcactgcaacctccacctcccaggttcaagtgattctcttgcctcagcctcccgagtagctgggattacaggcatccactaccatgcctagctaatttttgtattttttaatagagacggggtttcacagtgttggtcaggctggtctcgaactcctgacctcattatctgcccgccccggcctcccaaagtgctgagattacaagcgtgagccactgcacctggccaattttttgtatttttagtagagatcgtgtttcaccatcttggccaggctggtcttgaactcctgacctcgtgatccacctgcctcagcctcccaaagtgctgggattacagctgtgagtcaccgcgcccggccagggctttttgtattcatgtctgggccttaaggtttaactcagagcttcagagacataactgggaaggaaaaatgtatatttgtacatataaatattgtgtaagaaaagtaaatcagttaaggaagctgtgtgcccacagaagtaatatgtgattttaggagaaattttagaaaaaataattactattcagagataaccactcaagtttttcagcatatgcgcacatcaaatgtatattcatattagacctataaaattattctgtagtttgctttttttagaggacaatatattgcacctatcctttctctgtcagtatggctctgcatcatttataatggcttcatcgtatttcactgtatagatgcaccattattttgtaaaaccaattccttattctgagctgttttcattcattcgccattatgaacagtgctgtggtgaacaactttgtaaatacatccttttgttccttgtccaattatttccttaggataaaaggaatctttggtcaaggtgtacacatttttttggaaagggagggggtggtttatgaatatatccaatttccttccagaaacgttgctctaatgtacacacttacagggatatgtgtgtctttttctccttgaaaacaccagattttattattattattattattattattattattactattattattttgagacatcaaaataatccagctccatcacccaggctggagtgcagtagtacagtcacagttcactgcagcctcgacctctctggctcaagcgatcctcccacctcagcctcccaagcagctgagactacaggcatgcagcaacacacccagctaactttttttgtagagacagggttttgccattttgctctgggtggtctctaactctgggtttcaagtgatcctccccttcagcctcccaaagtgctgggatcacaagcgtgaaccactgtgcccagcgcaccattgattacattttagactttatttagatagcaccagttttccactaatgtccttcttctggcccaagacctaatccagaatactgcatcgcatttcatacccattctttgttacagcttcataatatgtaaccaatttaatttatttaacaaccccctattgttggacctttgggttatatcaggttttttctgtttggttttctgttttgagatggagtttcactcgtcgcccagactggagtgcagtggcaacatctcagctaaccgcaacctctgcctccagggttcaagcgattctcctgcctcagcctcccgagtagctgggattacaggcatgtgtcaccacaccctgctaattttttatttttagtagagacagggtttctccatgttggtcaggctggtttccaactcctgacctcaagtgatccaccggcctcagcctcccaaagtgttgggaacaggcgtgagccacagcgcctggtctctgatggatatttttaaaaaaatcactgtggtattcatgtggggcagagggtgagggggaggcagggattagtcctggcaagcaggggtggaggcgggaaggagtggacaaattcaaggtatttctgaggagcagtggaatctcttgaccaaggccttcttcagcagggagatggagccctgtcctgagggactttgcagcctggctggtaagacaagcttcttccccagggaattaaacaccagtggttaacagattagcaacttagagacgagaaagcggtttccaaactctaaaacacagaaggaaaacccgtgacagatttggccacataagtatttaaagcttgtatctgtctctctctctctctctctctctctctctctctgtccctctcccccgcccctcccctctgtctctcacacacacacacacaaacacacacacacagaacaatttaagattaaaaggtgaggggctgggagaaaactgagaaaggatggtcatctaggatttatcagccgctcccagcaatcaagaagaagaagacagataactgcacaaaggaataggaactgataattcccagaagaggagactgggaaaccggtaaacctaaggcaatatgcttaatctcattaggaatcaggaaaatgcaaagtaaacaaaggcccacccctaagagtagtagccaaatgtaaaggagggaagtgggagcaggaggagcctctccccctgggatggggaggagccggccaggttctgcggaagcagaagggggtgggtgtactactgccatggcgcaaacacacatccaagggctctgcagggggccccacccttaccccccagaccatttctaggagtaggggctgaacaggacccagtggaggctaccgtcctgcattgcgagggttaagtaagaggctgaaggtcaagtgcgaggtcctgcagggcacttccagcggctctgtctcagccggcccagtggccatgcggaactgggagcaaggagagtgggagataaaaccctgtttcagtggtttagcgtgggaaatgctaaagtgatctgtgtaacacagctcctgggtggggaagagatggggaagtagcctgtggcctggaggtggctagggacagattctcaggagggctggaaggggtcaagggcagggctgcgctataacttccctgggcagtgagcatcttggcctgcaggggcccttccaataagaaataggacctggtgtggtggctcacacctgtagtcccagctattcacgaggctgaggtgggaggactgcttcagtccaggagttggaggctgcagtgagctatgatcacaccactgcaccctggcctgggccacatagagagaccctgtctctaaagaaattttttaaaaattacctgggtgcggccgggcacggtggctcacgcctgtaatcccagcactttgggaggccgaggcgggtggatcacctgaggtcaggagtttgagaccagcctgaccaacatggagaaaccccgtctcttctaaaaatacaaaattagccgggcatggtggcgcatgcctgtaatcccagctacttgggaggctgaggcaagagaatggcttgaacccgggaggcggagtttgctgtgagccgagatctcgccattgcactccagcctgagcaacaagagcgaaactccgtcttaaaaaaaaaaaaattagccgggtgcagtgccagagtagttccagctactcaggaggctgagatgggaggattgcttgaacccaggaagtcaaggctgcagtgagctgtgatcccacaactgcactccagcctgggtgatagagcaagaccctgtctctctctcagaaaaaaaagaagtgcagattacaacttggtataataatgaataattactattatataataacacattttatttgacctaaagaacatttttttgccttctgatcctagaagtaattcacatgtgttcgtgggcgcatgcgtgggcctgtgcgtctaatggagaggtcactgcagaaaggaagctcagggttctcccaggcagcggcagggtgtggaagtctttctttgcctttttgaccattttgtagagggaagctgctctgctgtccagccctgcggaggggggcagggtctgtgtccccaagatgacagagggttggggagagttcactccagtgaccagtggttggccgaagagtgctttggagttcagcccacctgggtttgaatctacatcctccctgtgtggagctgagcctgaccagtgcgtgtgttcaccaagctcaggcgtctttgtttgtgtgtttttggatggaaaggggaagcagcccttcacccgctctctcctcccttgcagccgtgccacagggccagggttgcaatgaaggcaggtctcaggcaggtctcggctctgctctggcaaacgggccccagaggtctgaggaatccagccagctcctccaagctcatgtccttggtctcagacctacaggctttgtgcacatcctaggctggtgacagcatgtgtgtgtgtcacggctggagtggcagaggccctgtgggagccgcagacccagggccgctccataggtgtcaggctgtgtggtctgccagagtcccacacctgttcgtgtgaggggaaggtgcccgagcaatactgtagccaaccaaataccatagtgtcttcaatactactcatttcgcccatggaaaattatgcctaagccaccatacgggttaatgaacgctccagcccaggtccgaagagatgcctttagcacagggacgtgtggcagtgtctggagatgtgccaggctgtcacaggctgtgctcctggtgtggggacactgctgaacccacaggacagcctccacagcaaagcgttacatgctgaggtccagggaccctcccataaccaattccagagtgagggcttctgattggagagccccactctgcgtgtcccttagtcactcctgggacctaggtcaggcgtacacacacctgcaccacactgcctatatacaagcactttacctgtattgtatttatttatttttggctcactgtgttgcccaagctggcctcaaacttcctgggctcaagtgctcctcctgcctcagcctcccaggtatctgggactataagcgagtgccactgcacctggatttttatgcaggtattttaggtgagtcattggaggtacaatgctaccaacttgccacttcaggtggctccatcctgaagagcctcagcctcctggtctgtacaatggtaacagtgccctgcccccggggagctgtgggggtgagtgagaggctgtgtgtccagcccagtgtccggggtcactcagaaagagtggtgtctgctcagcgggggcagagcacaggcttgaggccagacttcctgggtaccagcaattcaatgagtgaattctttgagcaatgcctggcactgcacaagtcctgtggccgtgttgggtaccactgacattattgctgttttcaggtttgtttgtttgtttgtttgtttgttttttgagtcagagcctcgctctgtcacccaggatggagtgcagtggcgccatcttggctcaccgcaacctccgcctcctgggttcaaacaattctcctgcctcagcttcccgagtagctgggattacaggcatgcaccacgacacctggctaatttctgtgtttttagtagagatggggtttcaccatactgaccaggctggtcttgaactcctgacctcaagttatccacccacctcggcctcccaaagtgctgggattacaggcatgagccaccgcacccggcctgtttctagtttttgacagttgaacaaaggtgcttggcctggaacagtgaccaccaggtcacctcactccctcagtgtcaggggtctctctccaggctccaattgctctcatctcatctcagtccctcctacctgtcctcatccttatcactgctcctacagctggagaccagggtggggcacgtttgagatgggattcccattcagcctgtgcttcttggagacccagcttccctcgctccctcgtgctaccccatcaccctccactcccccatgctctcttccctagactgggcaggccccagctgccttcccacctggtgccccgatacacagccacccccacagtggcctcaagaggcttctttcctggccgggtgtggtggcttacacctgtaatcctagcactttaggaggccaaggtgggcggatcacctgaggtcaggagtttgagaccagcctgaccaacatggagaaaccctgtctctactaaaaatacaaaattagccaggcatggtggctcatgcctgtaatcccagctactcaggaggctaaggcaagagaatcgcttgaacctgtgaggtggaggttgcagtgagccaagattgtgccattgcactccagcctgggcaacaagagcaaaactctgtctcaaaaaaaaaaaaaagaggcttctttcccaaagagagactttgtcttcaaggtgacccctggctgacccctggcatggttggtgggagtggtgatggggcagcgatggggccatttgaattaaaatgccctctgcataattcacagaaattcatgagtcatctttatctgggaaaaccccaatggagtgagctgggacccagggctgcagactgatagacagagggaagcggcctccctggatcccggtcctcactcccgtgcctgctgttgactattctgcggtcaggaggcgtccctttgcctgcagtcctgggacagtggagcgcaggggacactggggcttcccaaggaagtgcttgttcttctcttaaatcagaaatcagggcactcattatgtgtctatccatcaggccgctgtcctctgcagagacaccttgggtgtcccctcctggctccaggtggttctggaggatggcagagccaggaccatgggctgccctgaaggtggttccaacctgctctatttaaaccaagggtcctttaaatttgtctcttttcatttaaatatgctctttaaaaaccagcaggctgggcatggtggctcacaccatgtggatggcttgaggccaggagtttgagaccagcctgggccacatagcaagacccatctctataaaaaaaaatttttttttttgagatgaagtcttgctttgtcggccagtctggagtgcaatggtgtgatcttagatccctgcaacctccacctcctgggttcaagctgggattataggcgtgcaccaccacacccggctaatttttgtatttttaatagagacggggtttcaccatgttggccaggctggtctcgaactcctgacctcaggtgttccacctgcctcagcctcccaaagtgctgggattacagatgcgagcccgtaattacaggcatgtgcccagccctaaacaatttttttttaaaagacagaaaaactccctgccccctggagttaagattcttgagaaggatacttgattaactgatgaataagacagtcagaacagtgatgagctctttgaaggatatgggtgaggggcaaggccacgttagccaagggggtcagggaggacctctgtgaggaagtggccttggttgtgaggcctgcaggctgggagagagtgatacagaagacctgggggaagggaggggctacacggcaatcactggttgtactgagaagtcattttgcacatgtggaaatatatttctgaagtaaattcctagaagagggattactgagtcaaaaagcatatgactttctaattctgatagatactgccaacttgtcctctttggggtgaaccaccaaagacactcccatctaccaaagacaagagtgcctgtttccccacagctttgccaatcctgtggattggcactaatctgatggttgaagaatgtatcttatgcccgtctggggtggctcatgcctgtaatcccagcactttaggaggccaaggcaggcagattgcttcaggtcacaagctcgagaccagcctggccaacatggtgaaacctcatctgtactaaaaacacaaaaattagccaggcatggtggtacacaactgtagtctcagctactcgggaggctgaggcaggaggatcacttgacctaggaggcagaggctgcactgagctgagattgtgccactgcactccagcctgggcagcagaacaagacttcatctcaaaaaaaaaatgtatcttattaagaatgagattgaacatctctttatatgattatgagctacttgaattatcttttctttctttcttcctttttttttttttttgagatggagttttgctctgttgcccccactggagtgcaatggcgcaatctcggctcactgcaacctccgcatcccgggtacaagtgactctcctggctcagcctccctagtagctgggatgacaggcacttgccaccacgcctggctaattttttgtatttttaatacagacggggtttcaccatgttggccaggctggcctcgagctcctgacctcaggtgatcctcccacctcagcctcccaaagtgctgggattataggcgtgagccaccgcacctggccttgaattatctttctacttgaattatcttttctcccaaccaactgttggtatcctttgctcatttgatgttttccttataaatttctagaagccttttttttttttttgaaacagagtctcgctctgtcacccaggctggagtgcagtggcacgatcccggctcactgcaacctccgcctcctgggttcaagcgattctccttcctcagccttccaagtagatgggattacaggcgcctgccaccactcgcagctaatttttatatttttagtagagatggtgtttcaccatgttggccaggctggtctcaaactcctgacctcatgattcgcccgtctcgccctcccaaagtgctgggattgcaagcatgagccaccgtgccctggctctaggagccttttaaatatgaaaaagattaacttttttatttttttgagtcagagtctcgctctgtcacccaggctggagtgcagtggcgcaatctcagctcattgcaacctctgcctcctgggttcaagcgattctcctgcctcagcctctgagtagctgagactacaggtgtgtaccaccacacccagctaatttttgtatttttagtagagatggcgtttcaccatgttggccaggatggtcttaatctcttgacctcgtgatccactcgccttggcctcccaaagtgctgggattacaggcatgagccactgcgcccagcccgaaagagattaacttttaactatgatatgtgttgggaaatatttttttcccagcttgtcatgttactttgactatgatatgtgtttgcaaatatttttcccatcttatcatattacttttctattttctttttcccccatcttatcatattactttcctaacaatcaactttactgaggtatgatttatgttaataataaaatgtgctttgaaagtacagtttgatgaatgttgacaaatgcaatacacccatgtaaccaccaacacaagacacagaacatttctgtgactctaatgttattttagaatatgagtataattgttttggccatggaaaaacttttctttttgtctccctctgtggcgcaggctggagtgcagtggtgtgaccacagctcactgcagcctcgaactcctggggtcaagcaatatctctctcctcagcttcccaagtagctggactaaaggcacgagccactaaacctgactaattaaaaatgtttttttgtagagatggatttctccatgttacccagtctggtcttaaattcctgagctcaaaccatctctttctttttttttttttttttgagacaaagttttgctcttgttacccaggctggagcacaatagcgcgatctcagctccttgcaacctccgcctcctgggttcaagcgattctcctgcctcagcctcctgagtagctgggattacaggcatccgccaccacacccagctaattttttgtacatttagtagagacgaggtttcaccatgttgaccaggctggtcttgaacttctgacctcaggtgatccacccgcctcggcctcccaaagtgctgggattacaggcatgagccaccacgcccggcacaagccatctcctgcactgccaaagttatgggattacaagtgtgacttacggcttctgcattttgtgttgtagtaagagatgcttttacattctgaggtttttaaataattcattgtttacttctagtctatttctgccttttttttttttatacattttgctcttcgatctatttgcagtacagcctgaggttggtgtaaggtttgagtctaataattttttttctaggggtgtatccagttgtttctgccttgcttgaacaaagtgaactaatagtagttcacgaaatctactggtttataatgtcacataccaaaggcttgtgtctttaaatctatctctagacttggtattctgctttctcattctgtctctccaaagatttccatatatatatatatatatatatatatatatatatatatatataaatataaatatattctatatattcatatatatatattctatatattcatatatataaatatattctatatattcatatataaatatattccatatatataaatatattccatatatttatatataaatatatatcatatatttatatataaatatatatcatatatttatatataaatatatatcatatatttatatataatatatatcatatatttatatataaatatatatcatatatttatatataaatatatatcatatattaatatatatcatatatttatatattaatatatatcatatatttatatattaatatatatcatatatttatatataaatatatatcatatatttatatataaatatatatctacattttttgagacagagtctggctctgtcaccccagctggagtgcagtggtacgatctcagctcattgcaacctccacctcccaggttcaagcgattctcgtgcctcagcctccatagtagctggaattacaagtgcaggccaccacacccaacgaatttttttgtatttttagtagagacggggttttgctatgttggccaggctggtctcgaactcctggcctccagtgatccacctgtcctggcctcccaaagtgctgagattacaggcatgaaccaccacccccacccatttccataccattttaattattgaggatttatagcgagttttaatattgggtaggtctaacctcctatcttagtttactattgtttctgtaacttaatagcttaaaacaacatagatttaatatcttacatttctggagggcagaagtccaaaagggttctcatggactagaatgaaggtgtccacaggattgtgaagtctcctctctggagactgtcagggaggctctgctctctgccctttccagcctctgcaggcagccgggtgttccctggctcttgctttccttccttcagagccctcagtggctggctgagtctttctcacgctgcctccctcttccgcttccaagaatccctgtggttataatgggctcacctggataatctgcccatctcagcagtaactgaccagcaacctaagttccacctgcaaccttcattccctcttgccaggtaagagcatattcacaggctccgggcatcaggaagtggacaactctggaggaccattattctcccaaccatgtccccgtcattgtttttcctctttgttttgagacagggtctcagtctctcattgtcacccaggctggagtgcagtggcgccatcatagcttactacagcctcatctcctgggctcaagtgatcctcctacctcagcatccagggtagctgggaccacaggtgcatgccaccgtatccagccattttttaaaaattattttattttatttattattattattattattatttttgagacggagtctagctctgtcaccgaggctggatgcagtggcgtgatcccggctcactgcaacctccgcctcccgagttcaagtgattctcctgcctcagcttcccgtagctgggattacaggcatgcaccaccaagtctggccaatttttgtatttttagtagagatggggtttcaccaagctgaccaggctggtctcgaattcctggtctcaagggattcatctgcctcagcttcccaaagtgctgagatcacaagcatgagccaccatgcctgtcctgttttatttgggtgacattaaatctatctattactttaggaaggacatgataagcattttcatttggacagactcctctcctcaggactatttacaatttacctaatgtaagtcttgtaaatctctgacgtggcatatgcctagtactttatcttataatttgtgtcttttttttcattctgtgttctcttgggttgttattctcctaaagaaatcagtctatttaaattttctgcctttccaaattatattttcccaggaaattagccatcgtatccaagttgtaaatttcaaatgtaagcagaacagtctcctattattatttacatttcttctatttctatagttatttccccctaatcatttcttattttgtgcatttgagccttttgccttcttttcttgattaggttagcttgctttttgtttcatttttcccccctccaaagaagcaacttttggatttagtcatttattctgctctattttctctctctccttccttccttccttccttccttccttccttccttccttccttccttccttccttccttccttccttccttccttccttccctccttcctccttccctccctccctcccttcctttctctttctttcttgacagaatcttgccctgtcaccaggctggagtgcaatggtgcaatctcggctcactgcaacctccacctcctgggttcaagtgattctcctgcctcagcctcctgagtagctgggactacaggtgcatgccaccacgcccagctaatttttgtattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttttgtatttttagtagagacggggtttcaccattttagccgggatggtctcgatctcctgacctggtgatccacttgcctcagcctcccaaagtgctgggattacaggcatgagccactgcgcatggccgctattttctattttaatactgtctggctttatctttattaattcctccaatctcccttgatttattttattcttttcttatttctttatattttatttactcatgtagggtttttttgtttgtttgtttttgtttttttttatgagatggactcttgctctgtcacccaggctggagtgcagtggcacgatcttggctcactgcaagctccacctcccccggttcacgccattctcctgcctcagcctcccaagtggctgggactacaggcgcccaccaccacgcccggctaatttttgtatttttagtagagacggggtttcgcagtgttagccaggatggtctcgatctcctgacctcgtgatccgcccaccttggccttccaaagtgctgggattacaggcatgagccaccacacccggccactcatgtaggtttttaaggatataaattttcgtctgaggacatttttatttgaaccccgcaggttctatatgttgtttttattatttttatttaatgtgctgcaacttttttttgtgcttgctctttgctgtaagagctgtttaagaaagtcttggtcaggaggggtggctcatgcgtgtaatcccagcactttgggaggccgaggtgggaggattgcttgaggccaggagttcgaaaccagcctggtcaacatagcaaaaccctgtctctgcaaaagaaaaactttaaaattagctgggcatggtggcgcatgcctgtagtcccagctacctgggaggctgaggtgggaggatcacttaagtcccggaggacgaagctgcactgagccgtgatcacaccactgcactcagcctaggcgacagagggagaccctgtcttaaaaagcaagaaaagaagaaagtccattattaaggtcttttaataactgccctgtgtcattgctttgtgattacagagtgctgtctgtgctattttcattctgtggaattttcctccaaatagctcactatggggtcagtatttatgactgttccattggtactggagaggcagagtatgttgtatattttcagggttctcagcttaaaatatttgtagaattctgatcttttgcattcttacttatttctgtccacttcatctgtcatgatatgagaggggtaattattataattttgtgatttcaattactattattcaaaactttgctggctaatcttgacagctaagttcactaaacataagatgcaagttgagctcaaaaatgttaaaatgtaggggaaggaaagtgtcttcgaatcaataggataatgcatgtttgtttcagcaaatcaactgtgggatgtttttacattttacaagaaaaatcccactgcaggtctagtttgtgattttgttaaatttgtagatttttttcttttttttttttttgagacagtctcactctgtcgcctatggtggctcacacctgtaatcccagcattttggggaggccaaggcaggagaagcctggagtgcagtggtgtgatctcagctcactgcaacctccacctcctgagttcaagcgattctcctgcttcaacctcccgagtaactgggattacaggtgcccaccaccatgcctggctaatttttgtatttttagtagagatggggtttcaccatgttggccaggctggtctcgaactctcgacctcaagtaatcctcccacctcagcctcccaaagtgctgggattacaggcgtgaaccactgccccgggctaaatttgtagattcttttggggaatagctggtagctttatgaagtggagccttctcttcagcaaatatggtgtttccccatttctttccttcttcttttatgttccttcatagttttacggttttcttcttcaggctcctatacgtttcctgttaggaatatttctagggattggtctttgttctcctatgaagggggtatttttaccactatgtcccctaactggttgttgttggtttatagtaacttcccctcctgcttcttttttgtgtaaagttatttagtaaacagctccctcactatttccaattggttaacacttccagagggataagacaatagaggatgcttcctttttacaaaaatgccacccatatttcataacgaagaataactttttaaataacagattaatttttgtccttgcaaaagtaatatatattcactacacagatttataaaatatagagggatgccgggtgtggtggctcacgcctgtaatgtgctttgggaggccaaggcaggtggatcacttgaggtgaggagtttgagaccagcctggccaacatggcaaaaccccatctctactaaaaatacaaaaattagcagggcatgatggcctgtgcctgtagtcccagctactcgggaggctgaggctgaagaatcgcttgaacccaggaggcggaggttgcagtgaactgagattgcaccgttgcactccagcctgggggacaagagtggaactctgtctgaaaacaaaacaaaacaaaattagccagacatggtggcgtgcacctgtaatcacagctactcaggaggctgaggcaggagaatcgcttgaacccaggaggcagaggttgcagtgagccaagattgtgacactgcactctagcctaggtgacagagtgagactctgtctcaaaaaaaaaaaaaaaaggaatgaagtactgatacatgccacaacatggatgaaccttgagaacatgatagtacgtgaaagcagtcaaacacaaaggccatagagtatatgatttcatttacatcaaagtatccagaagagccaaatccatagagacataaagtagattagtggttgccttggaggtgtaggggaatgggagggttgcagagtgatgataagtggggtttctttttgggcgcatgaaaatggtggctgcacagctccacaaatttactaaatataccattgaaacgtatactttaaataggtgaattgtatagtatgtgaattatatctcaataaagctgttaagaatgattcacaaactctactcattcaaaatatgtcaactctactctgccagatggtgagaacacggccctgaacaagaccaaggccgttcttgtcttcacaggatgctattctggtgaacttcctctggaactatattctatatccttacaaagaaaatacttgtcttgaacttctgagctcaagtaatccgcctgccttggtctcccaaagtgctgggattacaggcgtgagccactgcacccagcctaattgacatttcttgaagaatagcagtcttcaggtgattgaacaaacctgcctattcagaatctgcattttaacaagatccccaggcgatgtcattcacctggtacattccttttttaaaagcttttttctttttgttgtttttagagacaggactcattatgttgcccacgctggccttgaacctctgggctcaagagatcttccccactcagcctccagagtagcaggcgtgcaccatcatgcccggctcattgaaatttgggaagcacagatctagaggtcaaccttttatccaaagcagaaaccctatgtgatttcaattgtcaaactttatgtcaactctctatgcaaagcacaaaccccatctgtaccatccctatgtatcaggaacaggctgggaagtgacaattgaactctgctagaattgtcccacctgtcgggactcactgtgtggagatcccacctgtccacttgcgtgtgtctcacctttactttatttttaatttttatttttgagatgggatcttactctgtcacccaggctagagcgcagtggcgaaatttcagctcactgcaacctctgcctcctgagttcaagctattgtcatgcctcagcctcccaagtagctgggattacaggcgctcgccaccttgccaggctactttttgtatttttagtagagacatgattttaccacgttggccaggctggtcttgaactcctgacctccattcacctcagcccctcaaagtgctgggattacaggtgtgagccaccgcaccaagcctattttatttttatttttgagacagggccttgctctgtcacccaggctggagcgcagtgccatggcggccatgaacgtagctcactgcagcctccatctccctggctgaaacaatcctcccatttcagcctcccaagtagctggaactacaggtgcacaccgccatgcctggctactttttttttttttttaatttttagtagagataaggactcttgagctcaagagtgtcgaactcctgagctcaaggaatcctcccacctcggcctcctttgggattgcaaacgtgagccactgcaccttgccatttcacctctagacacccttttccttatttccaggtaaagtcagcttccctttggcagtgcctctgtatttgttttctactgctgcctgacaaatcaccacagacttagcagcttaaaacaacacacatcggccgggtgtggtggttcatgcctgtaatcccagtactttaggaggccgagacaagtggatcacctgaggtcaggagtttgagaccagcctggccaacatggtgaaaccgcatctctactaaaaatacaaaaaaaattagccaggcatggtggtgggcacctgtaatcccagttactcaggaggttgaggcaggagaatcgcttgaacccaggaggcggaggttgcagtgagccaagatcacgccattgcactccagcctgggcaacaagagcgaaactccatctcaaaaaaaaaaaaaaaaaaaaacaagcaaacaaacaaaaaacgacacacatgttatctcggtttccctgggtcaggggtcttggaacgggttacctggatccttggcgcagggtctcacaaggctgccatcagggtgttggctggggctgtctgaggctccaggcctcttccaagtgcattcaggtagttgacagaacttagttcctgcagctgtaggtctagggacctcagctcctggaggcacctgtagctccctgccacatggaccccaagggcaggccacagccatgaatgctcactttcttccaggccagcaaaggcctgtttctctgccttcctccacctctaaaccctcctttaagggcttgtctgattaggtcagacccacccaggatcatctgttttttttgttttgtttttgtgtttgtttttttgagacagtctcaccatgtcacccaggctggagtgcaatagcgcagtcatggttcactgcagcctcaacctcctgggctcaagcaatccgcccacctcagcctctcaagtagctgggactacaggcatgcaccaccacacctggctaatttttgtcattttttgtagagacacggtttcaccatgtttcccaggctggtcttgaactcctgaactcaagcgatcctcctgtctctgcctctcaaagtgctgggattacaggcatgagccacaacacccagccataatctcccttttgagtaactcaaaataagctcatcaggagtctaatctcaggagtgatatcccacgtgtccactgatccagcccaccccggaggggagggagttatacagggcatgtccaccaaggggcaggaatcttgagggtcattttggaatcccacttccctcagcccctgtgtagcacagcaccaagggatgccactcagatggtcatctatgtgagtggtgcggcgaccagcctgcacagccaagccggtggtgcttctgtggcttttgtctctctggatcagttggacttctttccttagaagcctcatagaattcactgaatctttcttcctcgtgaccttccttcagatcattcaagctttctccaggcaaaacagctccagcttcttcaaactggcaccatgtgacatgactttagttttaatttttctctttttaaagtttttaaaaataatagagacaaggtgtcactatattgagcaggctggtcttgaactcctgagctcaagtgatcctcctgccttagctgcccaaagggctaggagtacaggcatgagccactgcacccagccaacatgagatgactttatattcagtttctcaacagacccagatgcacagttggtgatgataaaataaaaacttcagctgaattaaatttaagagagtttaattgagcaatgaacaatttgtgaatcgggagcctctcaagccggagtaggctcagagactccagcacaaccacatggtggaagatttatggacaggaaaagggaagtgacttacagaaaatggaagtgatggccaggagtggtggttcactcctgtaatcccagcactttgggaggccgaggcggatggattgcttgaggccagaagtttgagaccagcctggccaacatggtgaaacccctgtctctactaaaaatacaaaaattagccgggcgtggtggtgcacgcctgtaatctcagctattcaggaggctgaggcatgagaatcacttgaacccgggaggcggaggttgcggtgagccgagattgcacctctgcactccagcttcagtgacagagcaagaccctgtctcaaaaaaaaaaaaaaaaaaaaaagaaaatggaagtgaggtacagaaacaatcagattggttacagctcagcgtttgccttatttgaacatggttcaaacagttgactacatttgattggccaaaattcggtgattggcacaagtgtagactacggtctgtttatacctccacttgttttgttttgttttggttttttgagatggagtctcactctatcaccaggctggagtgcagtgccttgatctcagctcacggcaacctcctcctcccagattcaagtgattctcgtgccttggcctcccgagtagctgggactacaggcacccgccaccacgcccagctaatttttgtatttttagtagaaatggggtttcaccatgttggccaggctggtctcgaactcctgacctcaagtgatcctccctccttggcctcctaaagtgctgggattacaggcatgagccaccatgcccacgcaacacctccatttgttatagttcactgtgtacagagaaacctttaagccgaacttaaaatatataaggaggcagttttaggctaatcttgatttaacagtgacaaatactttggcagtgtcacctgttttcttatgtatctatccatcctctttgcccttccttgaaaacattctagtttgtcaacatttcacttaaaatatagtatttattgagtgcttactctttgccagacactgtttgaagcagcatacataatgagattgttcttattgaatttctttttttttttttttttttgagacagggtctcgctctgtcacccgggctggagtgctggagtgcagtggcatgatctccgctcactgcaacctctgcctcccgggttcaagcagttctcaagcctcagtctctcgagtagctgagattacaggcacctgccaccatgcttggctaatttttgtatttttagaagagacagggtttctccatgctggccatgctggtctcaaactccgggcctcaagtgatccacctgcctcagcctcccaaagtgctaggattacaggtgtgagccaccatgcctggcctcattaaatctttttagcaaccctgtgagttgtatcatgccattttactggagaggaaagtcaggcacaaagaagttaagtaactccaccaagatcacacagctcataggtggggagccaaaatttgaacccaggcagtttgagtctaggacctgtgcagttagcccctatgcaatgctccctcccgaagccactctctgtacccagaaggggctgtcctaggaccagggatcattctttcttggcccctctgctttgcattctgtattcttcttagtaaacatcctcattcccatttgctttttagcagctatattatttcattgccttaaattgaactcagagtccctttaaaagatctgtgtttgtcacgtgaactactgaaaacaaggcttcccacatcctcattaaggtaaatgcaataaaaaaagtttttttttttggctaaattttttaatgtggttgcttttggtcattgtttcaaccagaggcccagctcagctttttatgttattgatatggcggcagatttcacatagagcagcatctcatttacaaagaacacagaatgccatgccatggactccagagatggaaaagtcctttgaggctgggcacggtgggtcatgcctgtaatcccaacactttgggaggctgcagtgggagaatggcttgagctcaggagtttgagaccggcccgggcaacatggtgaaaccgtgtttctaacaaaaattacctgggcgtggtggtgtgcgcctgtagtcccacctgcctgggaggctgaggtggaaggattggttgaggctgggatgtctaggctgcagtgagccgaaatcagtgccactgaactccagtctgggccacagagagtgagaccatgtcaaggcaagaaaagaaaaggtcgggcacagtggctcatgcctataatcccagcactttgggaggccgaggtgggtggattgcctgagctcaggagttctagactagcctgggcaacacggtgaaaccctgtctctactaaaatacaaaaaaaattagccgggcgtggtggcgtgcacctgtagtcccagctatttgggaggctggggcaggagaatcacttgaatgtgggaggcagaggttgcagtgagctgagattgtgccattgcactccaacctgggtgaaagagtgactccatcccacaaaaaaaaaaaaaaaaaaaaatgaaaggaaaggaaagggagagaggaaaggtgtgggtggggagagagagagagaagaggagaaagaggagaaagagaaagaaggaaagagagagagaaggaaagagagagagaaggaaagagagagagaggaagaaaagagagaaagaaagaagtctttagaattttaatgaaaggccaggtgtgatggctgatgcctgtaatcccagcactttgggaggctgtggtgggaggatggcttgagcttaggagttcgagaccagcctgggcaacatggtgaaaccccgtttctacaaaaattacctgggcatggtggtgcgtacctgtagtcccagctacctgggacgctcagatgggaggattggttgagcccaggaagtcgaggtggcagtgagccgaaatcagggccactgccctccagcctgggccacagagtgagaccctgtcaaggcaagaaagtcaaggcagagagaaaggaaagaaggaaggaagggagggagggagggagggaaggaaggaagggaggagagagaaagggagaaagaaaagagagaaagaaataagtccttagaatttaatgaaaggccggttgcggtggctcatgcctgtaattccagcacttttggaggcctaggcgggtggatcgcctgaagtcaggagcttgagaccagtctggccaacatggtgaaaccccgacttatttaaaaaaaaaaaaaaaaagaaaagaatcttgctgaaagaagagagaaagaagttcttagaatcttaatgaacaaaaactcaagtttctgaaacaagaaaacaaatgtctcaaatagtctaaagaatacggttttttactagggtgtttagcaattttcttgcagattctgatctatctctatgtgatataataggtgcaaagctcaactgctccactcagcggttatgtgtgggggcctcattttctccagctgtgggattgggaagcaagtcgattccttttttataattttgaaatccaggaaacgccaaaaccgttagctttctttcccatcagtttggcagaaattcactgaggtgaagagacgggaggttatttaaggcctctatttagctcatttaaggtgaatatccacacactttgctgagaaatacgatcagataagaggatgctgccccagctcccatgggacttgtatgtgctttgtattagccttctacaatccacagagctcagattctgaaacacgtctggccctagcggttttggatgaggggtaacacctgtaacacccagaggtggctgagagcagtgaatgagaatccacggacagcactgaaattcacaccttggggaacctctgatgtccctgtatctggccagtagtttctgccacttactgtttagatagacgcagagaaaacaagtagggacacaatttcggtagctggaagggagaacattccttcgccctccaactaagtgactctcctctcgcttctcaaggccaaggaagctctgccgtaaggctaaacgcgacactcagggagcatttggaatcttgccctgtggcctcttgcctctaaagctgcaagaccctttatgtggctctgctgtggaagggaaaggagtagagaaaaactactcaaatgactgcagagatgtagaagctttccttatcagggagagaatgggaagctgcgattgctgtttcctgttactgtagtgaacatttcaaaattatgacataaaaatggtttttgtttctttttttgagatggcggtctcgctctctcacccaggatggaatgcagtagtgtgatcacggctcactgcagcctcaatgtcccaggctcaagtgatcctcctgcctcagcctcctgagtacctggaactacaggtgcatgacaccatacctggctaatttttgtaatttttgtggagatggggtttcaccatgttggccaggctggtcttgaactcttgagctcaagtgacctacccaccttgggtggccaaaaatgttcgtttatgtatttatttatttttgagatgaagtctcgctcttgtcccccaggctggagtgcaatggcgcgatcttggttcacggcaacctccacctccctggttcaagcgattctcttgcctcagcctccccagtagctgggattacaggcgcctgccaccatgcccggctaatttttatatttttagtagagatggggtttcaccatcttggccaggctggtctggaactcttgacctcaggtgatccgcccgcctcagcctcccaaagtgctgggattacaggcgtgagccactgtgcctggcccaaaaatgttttttaatatctgggtttttattgttggtggtggtgttggggtgtttgtttgtttgtttgagacagcatcttactctcttggccagactggagtgcagtggcacaatctcggctcatcgcaacctctgcctccgaggttcaagagattctcctgcctcagcctcctgagtagctgggattacaggagcaagcaccaccaagcccagctaatttttgtatttttactggagacggggtttcaccatgttggccaggctggtctcgaattcttgacctcaagcaatccacccgcctcagtctcccaaagtgttgggattacaggcatgagccaccgcacccagccaatacctgtttttaaactatgcttctatgtagatgggttgtgcttgaaattatttcactagtggggaaacacactaagtaggagagcgacttcacattttatttattttttcagagagaggtgcccaggctggtctcaaactcctggtcccaagcgattcttccccctcagcctcccacagtgttgggattacaggtgtgagccaccgcctgtcacgtgttctttagacagtggtgattgtcccaggacctacttgcctcacagggtgtggtggggatccagtgagggcatctatgcaaagagcttagaacagtgcctggcacatagtaagggctcaggacacattaacaacgaatatggttttagagatcggggtcccagacaaagctatgccagtgctgaaacactgtcgatcggaaccacctaggagcaccttttaaaactctcaaagccaaggccacaccccacaccataaattaagtcacagcctctgggggtggggtctgagcatcagtattttctggaagtttcccaggagttttcaatatgcagccacgtttgggaactgtctggtctagaactttgtgtgcctgaggcctgcgctgggagaactgactttaaaaagacacagacaggcagtcattttgtagctagaggtgaagcagatggcgtgggggcagaagggtgtgggacctgggacccagcagggggctacggctcccacgggccttcgagcctggcaaccactggcacccccactccccccaggctgggatggagccactgtctgcacccgaggaggcctccagagcaggaggcgggagcagcagctctgagcccggcttgggcaccagagggagctcgtggggacgcgccacggctccatccctgcagctggttcaaactggtttgggcagggtgcggcctgggcgggctgcattccaggcctcaggctcgcggctgtccggggcctccccaagggctgcggacctagggcagggagcagcaggggcagggcccccgggcaggagcccagcaccctgagaggctggggagatgtttaaaaactcagtcctctttgtgtaaaatcatttacttggcctcccatgggggtccctgactaaggctggcagcgcggcggagcccctggatagggttattcccagacatcagtgtgcattagaatcgaagcagagcttgttaaatgcggaggcccagtgccccctctcaccaaagatcctgattcagaacgtctggggtgggcttctgggcatccatatttttagcaaaatatttctaaggtacaatcacatattcagaaaaaaaggctagaaacaaaatgattgtcaaccagccaacctggcccagggtatgaatcgctgggacacttgtgaaggacacagagaccccttccccagacctcctctttccccagggaagaggatttgggtaatcagcacttttagctaatatcccaggctttttttttttttttcatatgggcaatttcctttttctttttttattttatttttttgagacagggcctggctctgtcaccgaggctacagtgcagtggaatgatctcggcttactgcagccttgacctctaggctcaagtggtcctctcacctcagcctcccgagtagctgggaccacaggcgtgtgccaccactcctgtctaacttttgtatattttgtagatacaggagtttcgccctgttggccaggctggcctcaaactcctggcctcatgtgatccgaccgcctcggcctcccactcccaaagtgctgggattacaggcgtgagccaccatgccagcctggctttttttttttttttttaaatgagtcattttagacattcatacagttttggtattgctacaaacatcagccgaagaaataaaacattccgaatattgaaatccctctcagccgaacacctgacgtcaggagttcaagaccagcctggccaacatggcaaaaccccgtctctcctaaaaacacaaaaattagtcaggcgtagctgggtgcggtggctcatgcctgtaatcccagcactttgggaggctgaggcgggcagatcacctgaggtcgggagttcgagaccggcctggccaacatggtgaaaccccgtctctactaaaaatgcaaaaattagccaggcgtggtggtgggcacctgtaattccagctacttgggaggctgaggcaggagaatcacttgaaccctggagaaggaggttgcagtgagccgagattgcgccactgcacaccagcccgggctacagagactccgtctcaaaaaaaaaaaaaatattaggcgtagtggcatgtgcttgtaatcccagctacttaggaggctgaggcaggaggatcacttgaacctggaaggtagaggttgcagtgagctgagatcgtgccactgcactccagcctgggcgacagagcgagactctgtctcaaaaaatatatatatattaaatccctcttgggctgggtgcagtgcctcactcctgtaatcccagcactttgggaggccgagactggtgggtcacttgaaaccaggaattggagactggcctggccaacatgttgaaaccctgtctctactaaaaatacaaaaattagccaggcttggtggtgcttgttcctgtaatcccagctactggggaggctgaggtaggagaatcgcttgaacccgggaggcagagcttgcagtgagccgagattgtgccactgcactccagcctgggcaacaaagcaagactctgtcaaaaaacaaaaaaaagaaagaaagaaagaaaagaaaaagaaatccctccctcccatacccctctccagtttcttctcccccgccctaaagtaaccacttttggaacatggggtacgtcgttcccatgcacagctttgtacttttgctccatctgtcggtgtccataaacaatatacagtgtggttctgcgtgttttaaaaactgtgctaatggcacagtgccctacagagccttctgcaacacgacttttcttccttagctttatgtttctgagatttatccaccaggagaagtttgctgtgctcaggtcaatttggtgatctgaggccagtcctgggctctttgtgggagatgcctagccagcaggcaagggcaagggtctgagaccggctcccaggggatggcgaggagggctcagagcatcagggaaatcatgacaatgacgaatggccgagtgtgggctcagtgagttcctataaaacccttaagcacttgaggcccaagtctttgccaagaattttccagaaaatgactggcctgaaggcctggatatttggatagggagaaattagcagtggacagatttggaagtgggaattgtgcagtgatggactacacaaaaggcaggtcaaacatgtgttgtttaggcccctacctagggtggccaactacaatataaattcagatttaatggagaggaaggtgtgggacgtcctatatatttatttgcacccttgataccagcccctcctttttaaaaaacaacaacaacaacaaaagacagagtttcactgtgtcacacaggctggagtgcagtggtgcgatcataactcgcggtagccttgaactcctggcctcaaacaatcctcctgcatctgcctctccagtagctaggactacagttgtgccccaccacatcctgcaattttaatttttttttttcttttagagagatggagtctccttatgtttgcccaagcagctcagcctttttttttttttttttttgtgaggcgatttaacatttaaagaaaagtcagcaggcagggggcgctggcccacgcctgtaatcctagcactttgggaggccgaggcaggtggctcacctgaggtcaggagttcgagagcagcctggccaacatggcgaaaccccgtctctactaaaaaatacaaaaattagaattagtcgggcgtggtgacaggcgcctgtaatcccagctactcgggaggctgagggagggggagaattgcttgaacccggaatgtggaagttacagtgagccgaaatcgcaccactgcactccagcctgggcgacagagcgagactccgtctccaaaaaaaaaaaattaattaattaaaaataaaaataagtcatcaaacgaaaaatcaaaacttcagacttgtcttatacctatttgccttttagtactttcctcattagcactgttggggtgggagatgaggcgcacctcgctctcttcagccccaaggcttgtaaagggtctatctaggccggcctccgagggcatggagggagtgggtgcggttgtgaaatgtagtgcgctcaatagtttcctggtgaagtttattttaaaatccgcaccgaagaggaagacgaggaccgtcacactcggccttccctaaattccaggaccctccgcccgatgcaaactagatgctttagtaggatgggaacgggtggggggcgggcggctttgggcttcctctaagctagcgcctctctaacccggacgcccgttagaatcacccggggagttttagaaactaccgatgcccaagccccactccgaaggattccaacttaatcggcctggtgcgaggcctggcttccgggcttttaaaagcttcccggggattctattttacggccgggtccggggccgggagcctgtactctaccgggattccgatggggaggggtggcttgccccaatagttctcaaatttagctttgggtcaacaatctggttggaaccacctaacaaacatcaaaagatcctgatgcccaggtcttaacccagagacggtgtggtccaggcttgggaaattctaaaagagctccaggtgactgccatctgcaagcgagtttgcaaagcactgatgcccaggtgctgcgggggcgggcgcagcgcgcgccgctcgccactgggtggcgctgcccgctcggcccggcgctcctggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggtaggggacggggctgtggagttggaggagagggttctcgcggttaggggtccgggctccggaccctcggcttccccggagcatcctctcgctcccggagtggggggcccggggattccccccttcctgaagggtggctgcggggcgccacgcagagatgtgcagcgggtcgtccctgctcgctcctccgggcgacaccgggccccggaggcccaggctcgctttccctccccacccgggtcccccagcatccgccgggtcctcaggcgccgccctttgccaggccggccctgggagaggcggaccccgggacctctgctgccccggctacctccgagcggtgcccgggccgagcggcgcctcaggctgcggctgtgcgggccgcgctgcgctgctgcagctcggagcgaaaacaccacgcctctgtctgcgctttctattttaaaagcaccaagtgaaaagcagatctaaaacgagaccctctaccttccggctggaggcatctgtcgacgctgttgtgaaaaagttatttgtctgagttcactaggagttatttacggtcagaaattcaacccattctctttttaaaccacaaaagcagtacaggagtatttaacataaaggctatgcacccctttctcttttctctcccaccccaattctagttttcttagaaaaccagcattaactgtttggtataaatcattccggacatttaaaatgcatttacaaatgtagatatctgtatctgcctaggcagagtattggctcatgccagtggtcccagcattctgggaggctgaggcaggaggattgcttgggatggggataggggacggggaagagtgaggctgcagtgaggcttgatcatgccactgcactccagcctgggcgacagagtgagacatttaaaaaaaaatctatctcgccaggcctggtggctcacgcttgtaatcccagcactactgggaggccgagacgggtggatcacctgaggtcaggagctcgagaccagcctgaccaacatggtgaaaccccgtctctactaaaaatacaaaaattagccgggtgtgtaatcccagctacttgggaggctgaggcaggaggatcgcttgaacctgggaggcggaggctgcagtgagctgagatcagccattgcattccagcctgggcaacaagagcaaaactccctctcaaaaaaaaaaaccataaaatatctttccatatatatatatatacatatatatgagttttctcttttttctttttctttttctccatatatatatatatatatatatatatatatatatattttttttttttttttttttttttttgagatggagtcttgctctgtcaccaggctggagtgcattggcatgatctcagctcactgcaacctccgcctcccaggttcaaggaattctcctgcctcagcctcccgagtagctgggactacaggcgtgtgccaccatgctcagctaatttttgtatttttcagtagagacggggtttcaccatgttggccaggatgatctctatctcttgacctcgtgatccaccctcctcggcctcccaaagtgttgggattacaggcgtaagccacagcgcccagccatctccacatatttttaaaataatttttgaacagacgtttttaatttttttttttttgacagggtttcactttgtcacccaggctggagtgcagtgacacaatcatagctcaatgtagcctcaacctcctgggctcaagtgatcctcccacctcagcctcccgcatagccaggaccacaggtgcgcaccaccatgtcaggttaacttttaaaacaaagttattttgtggagacgagatctcactatgttgcccaggcgggtcttgaattcctgggcccaagagatcctttggcctcagcctcccaaagtgctgggattataggcatgtaccaccatgcctggcccat

SEQ ID NO: 73 - DNA, 1463 bp, Homo sapiens
accacacacacagcataaatagttaagcctactaatgaaatatcctgtcatttcctctacttaatagaaggctacagataggcttatacagtaaacatgtgaaaggtacagttgacttctctgcttgaatttgcacatggggggaattcgttctcttcttttgcccttttcacagaaccgtaaaatgtgaggactgaaggcaccttggaggatgcccagttcatccactggtggggaactgaagactagacagttacacggtagttcaaatgcaatcatatcactgcaattaaaactatgagaagactagattattctgtaatatcaccacattaggaatatgaatcactgtcaaatagcagatgcacatcatatggatatgattgatgtgatcacatcacttcttttagagtctgtggatgactggtcactgtgtattggtttttagttcatgcatacaaggcaaagtgtgtagtgttgttaccttcttgttccccagtgatccaagatttacaaaaaatgaataagtggaaattggctaacagatgaaagtacatcaaagaaacaaaaagtgataacattgggaactggaattccaattgaacataaaggagttctaaaaggatgacctggctatggaaggatgacagtcctgccctttgactgcctgtaaatacgcacccagaggaacttagtgaaagtgagcttattgacgtgtgcaaggaaaatggttctgacccataggatgtaggtgttccagagtaaatgacaccaggtgaaaaacttcacattaaagaaccctcagagatatttcagcacgttgaaagcacaaaggagaaaattcccgaaggtgattcaaatgtaggagcatgacaatttgtccagggatagcaaagatgcttattccactgggacagttatattgtgggatgagtgaaggcaggtcacaagtgttttacaaaggaataaaacactttgatggggtgccgtgggtcacacctgtaatcccagcactttgggagaccaaggtgggcagatcgcttaagtccaggagttctagaccagcctgggcaacatggtgagaccctgtctctacaaaaataaaataaaataaataaaacacgttaattctcaatgtttccagtcttctaaattatagtgtactaagtacatttagttttattatttagaaaatgttgtctatacatttataaatcatagggagtttgtcatgtttggacaaaaattcttaaaggtcatggaacaatgataaacaatgtgaattttcccaaagcttgtctgaagacatttttatggtcctgtactagcatgcaaactgaggactgcctgtattttaaatgaataaatatagactgagtgaaagtccaaaaatattggcttcttttatttggaattatctcagcttattctgttaactacttatttgctttaacaaaaacaaa

SEQ ID NO: 74 - DNA, 4649 bp, Homo sapiens
cttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtgggtagttggaggattaaatgagatagtatgcaaatagaggagagtaggtaagttccccctccatcactggatgtttttgctacttcccctactcttttgtttgtttgtttgagatggagttttgcttttgttgtccaggctaggtgcaacggtgcaatctcaacacactgtgacctccgcttcccgggttcaagcgattctcctgcctcagcctcctgagtagctgggattacaagcgtccaccaccacgcctggctaattttttgtattttagtagagatggggtttcaccatgttggtcaggctggtctcgaactcctgacctcaggtgatccgcccgcctcggcctcccagagtgctgggattacaggcgtgagccaccgtgcccggccccctcctctctttttatctctctgctctttagttagctggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaatggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacaggcatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttccaagcaaagggatagagagctacaaggtggaattcagcaggctcacacctattgggtgttagagagatgaacttagatcacatttatttaaacatctctgagtgcagtatttttaaagatcacacaagaataaaactgtagcactgaacttttctttaagtgttgaagtgaaggaaatgaagaactcagcacggaccctgcttagactccggcagaacaggtggtcttgacatgacgtcgctccaacatgcacgcaacttgccttttattctctcagctctttgtgccactagtacatggtcacctgggcatttctttagaaagggtgcagagactttcatttcgtgaaaatatagatgtcccagggaaaaataataatccaactggtataagtttatatcaaaccatatggaagtgattttttctggttagtcattttcacggggattagagagtagagaaaagtcaaagaaccagggattcccaaggacacacttggcctggtcaatattactaggattggcccagatgccaccaaatccttttttcttcctacttattgaaaaccctgttaaatttgatatgtgtaatatcttttctctaaaattttagccttgcaaataaaattttgcataacatttttattgacaagacattgtgtcacattaaggcttttgaaggtgatgaaatggacatgacatcttcaccttagcaagtaacactgaattaaagaagtttgtatttcagagtggaagagtacagtataaaatatttgaattcagacactttagagcttggaccctgtcagaagcttggaaatacttcgattttaaagctgctactcttccatttacctcactccaggaaatccttttagaaatcatactcttgagggaagaagacctaggggatagagcatgactccactgagaaatttaatttaggaaaataatgggggaaggggctgtagcctagaggctaaaaacccatgctctggagctagactgcctggcttcacatcccagccctaccaccttttaactagtgtactgaccttgggcaagttactcaacctctctgatcctgctgcttaatctgtacaatgggatgtgtggtagtattggccttgtagggttatttggagcattacttgagtcaataccagtgaaggcacatctttagcagaatgtgatgactgaacatgcactcaactggggactcgtttgttgtaaagattatccaggaaattgggaggagcaaggtagtcatcaccaagtataggacttgagggaggtttccagacctttgaggtccaaattgcaaggaggaggggaaggaaggatggccaggcaatagttgggagggaagtgaagtgaagaccccaggctatctgtcggtacctttgctggctgctgggaggggcagtgtctggactctggagaccacgcctccagagaccacaccctccaagaggccacacccttctagaggccacgccttcgtggaaaccacacccccccccttgctctgggccagttggcagcccctgctcttggggctggaccactccttcccagagaccatccattgtacaagaagcacggtctttgataggcttggaggaaaatccctcttccctctccggatccataaggactgcagagagcagccctcacacagcaaggctaattcctggaaacccttaagaaccccagatcagcttgattccaacacaaaggagtaatcaaggcggttgcaaaggaaacaatggcaagtgttttgtgaagcatttttttaagagagtgtgatggaaaattttctttttgaggaagaacatgttctccttgttggaaatgaagttgattttagttataattactaccaaagacaaaggttcattttcacacagacaatgtgatgaagccccaaacagtggaagtcagctctgatttcaaaatagacgcgtgaaggtatccgtgcctctgggtgagaacaaacttgtaggcctta

SEQ ID NO: 75 - DNA, 3360 bp, Homo sapiens
acctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttc

SEQ ID NO: 76 - DNA, 5796 bp, Homo sapiens
gaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttc

SEQ ID NO: 77 - DNA, 7408 bp, Homo sapiens
gaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaaga

SEQ ID NO: 78 - DNA, 65600 bp, Homo sapiens
ataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggca

SEQ ID NO: 79 - DNA, 158375 bp, Homo sapiens
aggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacct

SEQ ID NO: 80 - DNA, 168761 bp, Homo sapiens
tcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaatt

SEQ ID NO: 81 - DNA, 242847 bp, Homo sapiens
aactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtg

SEQ ID NO: 82 - DNA, 2560 bp, Homo sapiens
aaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 83 - DNA, 2662 bp, Homo sapiens
gggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttc

SEQ ID NO: 84 - DNA, 3007 bp, Homo sapiens
aaagatgcaaatgacaatcttttatcaacctgagagcattcattgaagtcaaatcaggcattctgggaaatctaggtttccttgtaacacaatttgcaaaccactgctctgagggaaagtaaggggacagcaggaagcagcctgtttttattgtttgaggatagcttcctaaagcattccaatttgagaaataggacgtggttatttgagggagttccagggggtatcgaggctctgatgtgggatgggcagtgccagcagatggctttctgctcagacagtccagacattggtatgagggccaacctccaagacaggttctgaaacaaacaagaagggagagagaagcagtcccatcttttccccagaaacactcacaactattctacttttccttttttacacagtttatatgtaaacccagcacaaggccctctctcaaacagacctacatatccctacaaagacatgccaaacttcacacaggtgtgaaagtatgtgtttgctcagccaagaccagccactgaccttgtgaattgcttgtttctacactattcctaaaacaaaagtcatatttacctacacagatcttgccaaatgagtgcagttttctttttttttctttttttttttttttttaattgatcattcttgggtgtttctcgcagagggggatttggcagggtcacaggacaatagtggagggaaggtcagcagataaacaaatgaacaaaggtctctggttttcctaggcagaggaccctgcggccttccgcagtgtttgtgtccctggctacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtacagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgggtacacctcccagacagggtggtggccgggcagaggggctcctcacttcccagtaggggcggccgggcagaggcgcccctcacctcctggacggggcggctggccgggcggggggctgacccccccacctccctcccggacggggcggctgccgggcagagacgctcctcacttcccagacggggtggctgctgggcggaggggctcctcacttctcagaccgggcggctgccgggcggaggggctcctcacttctcagacggggcggccgggcagagacgctcctcacatcctggacggggcggcagggcagaggtgctccccacatctcagacgatgggtggccgggcagagacgctcctcacttcccagatgggatggcggccgggaagaggcgctcctcacttcccagacggggtggcggccgggcagaggctgcaatctcggcactttgggaggccaaggcaggctgctgggaggtggaggttgtagcgagccgagatcacgccactatgagtgcagttttcaactaaaacagaaatctttagatcttgggggaagtttttatctgtaagtctagattcctgtttttccacttgcattttttattcctcttccccactctgcttctatcaacagcaacctttgttagcctaaatctctggctccctttatggtccagcagttgggcagggtttgaatggcaaggtggttctagaaaaacttctcatagaagtgttttgatcaactctgtgtaagctgatttttatccagagtgctgttataaaagcattaggttgggagtctgaattcttggaatctattttccttctgccactgatttctcaatgtgccccattgactgagaagtgagttttttcttttttctttctttttttttttttttgagatggagtttccctcttgttgcccaggctggagtgcaatggcgcaatcttggctcactgcaatctctgcctccccagttcaagtgattctcctgcctcagcctcccgagtaactaggattacaggtgcctgccactatgcttgcctaaatttttgtatttttagtagagacggggtttcaccatctcggccagcctggtcttgaactcctgacctcagttgatccacccgccttggcctcccaaagtgttgggattacaggcgtgagccactgcacctggccagtgagtttttactatgaggaacatggtcaacttgttgacaacctcaccggcttggggtacaaagagagtcatatttctttgagacttgactcttccagaatacagggtcagtgagagactgggaaattgcagggagactctgatgatagcctatgatagactgtatgcagggagtgacagaaggtccatgcatttacaaatatattctgagtacctgccagttgccaaggactagcttggtgctagggttagagctggtgcctgacctccagcttatgttgaaaaggaaatgtggttatataaacacctaagtgcagtaactctccatggtgttgggataggagagctgggtgtagaatgcagtggaggtgggccgggtgtggcggctcacgcctgtaatcccagcactttgggaggccgaggtgggtggatcacctgaggtcaggagttcaagaccagcctggccaatatggtaaaaccccaactctactagaaatacaaaaattagctgggtgtggtggcgcacgcctgtaatcccagctacttgggaggctgaggcagaagaatcacttgaacctgggaggtggaggctgcagtgaaccaagatcatgccactgcattccaatctgggtgacagaataatactgtctcaaaaaaaaaaaaagaatgtagtggaggca

SEQ ID NO: 85 - DNA, 1193 bp, Homo sapiens
cagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgact

SEQ ID NO: 86 - DNA, 1851 bp, Homo sapiens
aagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccattta

SEQ ID NO: 87 - DNA, 1453 bp, Homo sapiens
actattgttgtaaagtaaccatatgcacgttacgaagacatatatagacgagggggaaaggcacactcttcttccaaggaagattatgagctctatgatctttacccagatatacaagggtaaattgaggctctcactcctctggcctcttcatcttttatttctcggggggttttttgtttgttctttttttctgagacggagtctcactctgtcacccaggctggagtgtagtggcactacagccttgacctcctgggctcaagcaatcctcccacctcagcctcccagtggggactgttgtagggattaaatgaaataatgcatataaaacagctgaacacagtacccggcagacactagtgctcactaaatgcgaactatattttttactgaagtctctctttaaaagtccatccagaggccaggcgtgatggctcatgcctgtaatcccagcactttgggaggccaaggcaggcggatcacctgaagtcaggagttcaagaccagcctgccaacatggtgaaaccccatctgtactaaaaatacaaaaagtagctgggcatggtggcatgcgcctgtaattccagctactcgggaggctgaggcaggagaacagcttgaacctgggaggtggaggttgcagtgagctgagatcgcaccactgcactccagcctgggtgacagagtaagactcccgtctcaaaaaaaaaagttcatccagaacaaacacttcaccatatacttcttatatcttacacatacttcttatgtgtgtcaactacaaatatctaagcatttttgtgacaaactcaaacagttaaaaaagagcataagtaatctctaagcctataggtaagtgatttttttaatgccttaaggacatgttccttcccaatataaaaacactcaatattccactaaagacaaaataatgtttttgaaatctaaagaaatgatcaagtcacataagagttacttaagttattctagagaaatgtggccagttttcagcaaacagaagaagaaaaaacaagaaataatgccatactacaatggcaatggaagtctcattcacaggttctagatcatcccaggtaacatgttctaaacatgaatacctttccttcctagttacctctgccttcaaaacaagcttgtgtcctgtctcccaagtaaaattcctaaacacaggaactaggtctcaggcatatgcaacatggacgaaatgagatcccaaacaagttccatatattcaggatggcgactgtggaaactgaacagaaaacaaacaaaaacaaagaggcagccttaccaataatggcattgtttcctccaagttccaacagacttctcccttaaaagaaaaaaattatatataaaaattaatgcctacttccatatttactgcacactgctacacagcctaatcccaattattaaattatatagc

SEQ ID NO: 88 - DNA, 1217 bp, Homo sapiens
ggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaattta

SEQ ID NO: 89 - DNA, 1426 bp, Homo sapiens
tcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaa

SEQ ID NO: 90 - DNA, 4534 bp, Homo sapiens
acatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaa

SEQ ID NO: 91 - DNA, 6350 bp, Homo sapiens
gagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggcca

SEQ ID NO: 92 - DNA, 38815 bp, Homo sapiens
aaagttgaagagggttttcatcattctgacatacttcattctagaattatggcagcaaggataaaacagcattaatttgcacaaaattacaaaggtaatattacagtacatcacttattttctaattgtaacttagttccaaggctttgggggggacaaaaaaagcattcttttttcaatactccaagaaatttaaactattagaatgactctcagataccaactcatgaatcacacatcacactccctgattttatattaaatgattagtgaatttaaattttaataatgcttatgtatagatttactaaaatatttttaatcattaagaataattttaaatctataaactttattgtataactacatgttccttttaaaataaatttataaaatatatatcaatatcatagaaatataatattgtatcgtataggatatcagagatacttactacataatgtcgctaagttattttcctgacagacttgataagaatgacagtgactccaacaccgtgttaatgatagtctatttgctgacttttgtgagggaagtgcagttggtttgacttcgtacatttcttaagacctggttatttatagatttgctggtcataagacagctttgatgaccaaatattaagggatatttaacccaagaagaaataggatttactatatactcagtgccaacaatttgccaggctgtacaccaacatgatcccattaaatatgaacaacaaacctctgacgcagttagcaatagatccagggtggaaatgaagaaactaagagacacgtagattaagtaaactgtctaaaagagaaccagaaagtaccagccgcattttaaatacctgccagtcaccccgtgctttcccaatgtttggaggacatcgcatgccctacaaaattagggctcttctgcagagatggaggtgataagcctccaatcgccaaaccaaaccatgtgaggccaggaagggcagaccctcaggggctgcagctgggcatggctaaatgctgtaacccaggattttttcctagaagtaacactttctgtgaaaggggaagatttctggctcttatcaatggaagtcactgtcttccatcaaaaaaacaaatgatttaatctccccctccctctgtaacagagttcacagagaacagaaacttggtccacataaagaaaggcaactcctgaagaaactaatagctacgagaccctttaaggacacaaatccacgttaaattctaggctactgcaaagcagcactgtggctagacctacggtgataattggcaaagacgtgccactgagcttccagctttgacaaattacaatcagagactggaatttttctgtgtttaattattaaaagctttgatgctttcataatgccagtgagattggaaaacagaaaaatgatccatcagtacacaaaataggaagatgaagaatatttaggcagtccatgctgagatgttttttataactcggctacatgatggaagggttaggaattccttagagccaagttcacagttaatgacagaaacatgtagtaaatgatacaggctttgtagcttttagaatatattaggtcaacaaacattttccaggtcactatctggagcagatgcatgccaattagtaggctcagtgggagcctcacccatcccataacgtcctttattaattcttatctgggtgtgccacatatttcatttgctttactgtttcttaaatatatttggcctttaatgtttaaatatcattattgtgggtaaatcagtgcagttgaattgcttttagaagattcgggactgtgttttctttgatgattaacattgaaaatgtgaacttgtaacacatttaaagtgaggaaattcaacgttaatttctatggtttttatcacttttgaaaaaaagtcatttttcctttgatgataacattggaaatgggaactggtaacactcttaaagtgggaaaacctgatgataacttctatggttttatcacatttggaagaagtcacattgtagatcattagaattcaatgtgtttatgctgtgataatttactgatgatgaagtcagaagaacccaaaataaaatataatagagaactaagttcaagtgaggacctatagagaatgagaacacggaactttcaacgagatacacattccagggttgtatgtgattcctgaaatcagatttcacaatctcttacaaagaagtttcttatttgtcaattacaactcaaaaaagctggaaaaaagtttctgatgtacaggaaacaaagaataattaaaatattaatggattatctaacttttttttttctacattgcattccggaacgacattcccaacacacagacttctacgcacagaacaacgaagaaaaaaaagagaaagaaaaactattttctgcaagaagtcaagtgatgaatgttgtcctaaaacagtctgcggaggcgcaggggaggaagtgggggtgggcagtacgaccaggaggaagcttcagggctcctgggcaggggagtgtgaggcctgaggtcattaacagtaagcactgactggcaaattaataacatcaatttaaacagttataattccacaggatcctctatcaagctgattctaaatgagaaacttttctttacggatatgaaatgttttcttctccatatcaaaaaggagacaggggatttgtatttaatttttttccctttagtgtagaagggaggaaacccacgaagctgcagatggccactgtggacttctctccacggggtgaaatcaccaactgccccttgagtgtgtcttcaagtatcaaagccctgagaacttacagaagctttgtggccacctgcgcccggtagtggggaccatctggggtttcctgtgcctggcaccagcacgcacagccagacctcactggcaaggcccagtgtgaaagtgagggactaagtggctaatctggctggacttcctaggtcaatagggacttccctaagggggcttttccctaagccagaatgagtcacagctgcaaactaagggactgaaacttcaaccaatcatataggaagtttaagctctagttgcagcctgatgtttttaaccaatcaggcccaccaacccacaagcagatacaaaataaactaactctataggacagaaaaaggaaaagcggaggggttataaggagatataagcataagacacccaagccagaaacagcaactcttccgggtccccttccacctcttggaagttttactgtcgcttttgctttcctttcactttcataaatcttgccgccgcacactcttggggtccgcacgtttctctaattcagctgtaacactcgccgctgcagtccacggcttcattccttgaagccggtgagaccaggaacacttccatcgagaaaaaaacctttgatcaggagaagacttcttgtctcaaaaggaagataactcttggggccccaaaattactaaactaaagggaaaggtcgagctgggaactgcttagggccaacctgcctcccattctattcgaagtcacccctctgctcactgagataaatgcgaatctgactggcttctttggaaaagctaattagaaactctaaagagcgcaactgtttgtctctcacctacttgtgacctgcaggtcccctccctgctccagttgtcccacctttctggacgaaaccaatgcacatctttcatctgttgcttgatgtcccatgtctccctaaaatgaataaaaccaagctgcgccccggccgcactgggtacacgtcggccggacctcctgagactgtcaggggcgcgcagcctcaactttgttaaaaataaacattctaaattaactgagactgaaactgcctttgcagaattataactgaggaaattatgtcagtgacagaaatcagacctaaccaactctatgttgcttctaacctttaagttgtccttgttcattcctgggcataggctgaactaaatttgcgaaggaattcagttcacagtttgactctgaaacaaaattgtttacagcccttatcaactgatagagcccttatcaattgatcaattgataacagcccaagaagacccccatcttacctggtgtccagtctgctttgcaggactaacaaattagctacaagtttaggacttacggtttaggagacacgcagcctctggctccaagagtatgaaccttcccaaattgcttctggggatcacattactattgtaaaacctaagatctaagatcggtggttgtgatatgttgcagaccctgcactccatggatcagctgataccaccaagacttttaatctggcccgaccagttttgccattgcacccagaaacagaagacagcaagaaaaactcactttgaccccctgtgatttcatcttcaacctgaccagtcagcactacccacttcccaagcccccacccaccaaattaccattaaaaaccctgatccccaaatgctctgggagactgatttgagtaataataaaactccagtctcccacacgaccggctctgcatgaatcactctttcttcatagcaatgtccctgttgataaattggctctgtctgggcagggggcaaggtgaacccactgcatggttacgagacctgtctcagctattcagcattcacaccagaatggtgccaaacacccatcacaggacagcaccctagcgaagacacaaaccaacatagtaacatagatttcacttgcttaacctgtgcaccccacctccatgggcacactggaagcaggaggtctcccactgatggtcagtgctgcagggaggccactgatccacaattgtgggatggagactggggacgggccaccttctgctgtctttcatcaatttatactgcacatgtccttgaggctttctgtatttggttttcttctatctccttattagattctgagggtttattaatcattggttggttacttcactctcctggaagctgctcctctccgtttgaaaagccaacaaaaaaataaacatacaactcttttctcatagaaacaggcaacacttcattctggagatgtgtcctaacctggggtaggagatgtccaggacaagtaaagtggatgttggcaaagatcagtcccaggaccacagcatctgtctcctgggaatgggttagaacacaggctctcacgcccacacagactctgctggaagagaccctgcaggtgaggacctacactgtcaagctgatgctggtgcacattcgagtttgagagccactggcctacaaaatatatataccctggcctccaaaatcatagttcaagttttagccaaaaatcagtcaatctcctgtgattttttttaacaatcctagttatctgattcacccagagaaatgcttctctgatccatctttgcatctgctgcagaaacaaaggatatttaaagttcctgctatccctggaggtggctgtccggccccctccaggatcaaacccatggccttacggaaagcttctaacactacaggccccgctccaggttattctcatgcggctccctctgcttttcagatttcttattctagacttctttctttctggcagtacaagcctctcccttccttctttatccttcagcttcagccacctgaaaaaaaatctccaatctggaaaatctaaaccaaccaccttttctgaaaggacacagttttccaagcattaatgaaaaaaaaaaaaaaaaaaaaaaaaaagaaaatcataaaaactaacttcaactgcagacttctccctccaccagaaaccctttggttttcctagtcagttttccttcctttccacagagggattttctaattgtttctactttcccacaccacatacaacacccaaagtacctgtatgcatattagaaccactcaccccctttacttagactacttataaggaagatattaaataataggcagtcatgatgaataaatttaagaaaggtatattcagcatttactatgtgccagctaccaagtcttgacatatattgtctcatttaatctttactctgaagtagatggtatttgtactatcattatttatcattcttattattattgttactgttttgcagatgaagaaacccagacactgccagcaaatggtgaaggcagaattaaattcaggtactctgactccagagcatgcacagttaaacactattctgtcttgcaaagccttgtgatattggtaaatgccactgctttgggaaagggatgctgtcacttgagcaagtaccacattttatattcttcaggtgatttataacatctcaagagcagtggacaagacctcaaaatggttcctcaacagtcttcacatgcatctggcaaacactgtcaggccagcactcccacccccacctctggagaaaagtttgcactcttggtcggggacccctgcggaaaaagtgccctgagaaaacagcagctcctccttgaaaggcatgtttctgcatggctgacaggtgcaatcccgtggaggaatgcatgagtaagaatgatctgagaagactcgtgaattactacaaattagggtcagtttttaatgaggagacaagaacgtgaaccaagtaaaaacttatgtggatggtaaacagtaccttcgatttggaactaaaacatctgtgatgactctattgggaaagttgcaagacaactatgaatgcacatatgccattccacatgctctccaaggtttaaaatttaaaacaaccaaacaaacaaacacattgcttactcaaaccccctcctatattctatttttacagataacacatctcatctcttttagcttatctccaaaccttcaaagaccattgttacaaagcccatgcttgctttttcctcttgaagctttagctctccacatggaaatatgtcttctttctttcatcccataccccacaacctcacgcccacacactgtccactcatccttgctggatacttatactttcatcccacacaccacagcctcacacccacacaccatcaactcatccttgctggatacttatatcctagtgcaagtagggtaagtttcgggattcatgtcattattggtaagtgttacaggctctgtgcatgcgctgtatcatgaatatttctgtctcgtacaactcatattgttttaagaattcctgttttagccgggcatggtggcatgtgcctgtagtcccagctacttgggaagctgaggcaggagagttgcttgaacccgggagtcagaggctgcagtaagccgagatcgcgccactgcactccagcgtggttacagagtgagagtccaactcaaaaaaaaaaaaaaaaaacaaaacaaaaaaaacagaatttttattgttgttgttgcttttgtttcatctgtacttatcaccaacacatccccaacctcttcttccactttcaacatctacacttaatatgttcaaattcagcagattcctatcaatttcctcttctgaggatgtctcctggggagccttcagatctgctgtcaacaaaactagcacagtcattatcttctccctcttttcatgtggagcctgggaattcattttttgaaccttcttgaatgcattcccagtttccttgaccacctccacccccaacacaccatgttctcctttcttggctaatttcctcttttaggtagatgtactgagacaggtgcatgggagataaaaattgtgaagttttgtattgtgaaaaagtctaggagtaaatgacattttgccagggcataggaatccgattttgagattggattccatcagaatattttaggttatttactttacgttttttattattattattattactgacctactctgacttgtttcctctctggaaatttggtaggatattctcttttgtcccaatgttctgaaatcacctaatgacattttgttatacaagtccattttcattcagtattcagttttcttgggccctttcaatctggaaataaccatcctggaaaatttcttcaacaatttaattttctccatttgttactccaactttattttctaagttgtctctgacaccttttctttcctagatggttcctgctttttcatagcattctgttcttgttttgtgaatataatatatccttttacttctcaggtaattttaacaattatatatttaagttcttatatcttgcaaattttcagtttcttcccagttgctttaccctatgtgtttattgggaattttgcctttcttgtcagaagatttttatggcagtctgcttatattagaagaaaatgatcgaacctcctgagtgtgtgtgtgagaggagggctagggctgctccatcaccatggagtcactgtcagtaaatcaagcttgcttattttactgaaaaagacccaacatcttttccttagttctttctttctcttgagtggctcagggtccctcactttcttcttgtcagtctagtatgtaagtttggagagccaaggatgtctatattcatgcaaacgattagtttaacatctttattctggtataatccccaaatatgcctaaggtcttctattccaaagacccccagtaatggaagtggaatttgatcctaattccttgtaaaatatacttttgatcaacttttttactctgcctcaccgtcatcctcagtttagtgcaaaaatttctggttctgccaattgctgaagcttttgagtgtaccctgaggcgagttgatttgattcttggctttctgaagttttgcattaggattcttctttcctggttcttttaaatcaattaccactgaccttatgttttctaacttgcaaaattgtattacgctcttgtcttctaccatttaatttgtccttgtgaacttgtgactttgaagtaatcattttgtgattataatgtaattttagtggaattttggaggggagtagataacacatgaaagtattttgtctatcaactcaaaggaagattttgaggtggttaacatttttctttgtaacaaaatctgtcaatgcttacaaattatatatttgtatatataatattgtactatgtgctatattatatatatattatttaacttagaaagagtgttcatatgctgagataggtagaacaatgcattggatggacggattaattattcaggctttctgaatatcatatctaatctataaaatagaaaacattatactttggtcttaaaagtctctccctgctgttggaatctagcattaatgactccactggctcaagcgtgattggatttgtcctaatcctttttagaaatgcctcagagaagtgtgatttctaactgctgttaaaaggagaaccactgcttattcatttacaagttataatcataatgtagattttagacaaaagactgagagtagtacatcaaaagacttcatagttaaatagagacgccatttctataagtatacggcatgtggtgtggctgagtacagaaaggtaggagatgaactgtaggaactgaagaggctgaatctacacagagcttcctgtaatgtgaggtctgactgtgctttcatcttccacttggtgacacctacacgctcctcaaaataatattctaatcacatcccttaagccttccttgagctatttgtaccacctctctctcaactacccctgaggtcaaatatacgattaaacttcttaaaaaataaaagtttgaaaccaaatattttccccttggatattcactaaacattatgtttaatatcaacgcattttgtctttaactgtagaaaatatttttctcatatattgataaactgcatagtccctaatgcttagttttacacttgagaataggtacagcttcttgactagttctcaagtaaataaaacttaaaatgttagatagacttcatttattgcatcccttgcaaaaaatatactatcagaacaatgcagttgttatcaagattaaattagtatacaaatgtgacttttttttttttttttttttttttgagacggagtctcgctctgtcacccaggctggactgcagtggtgcgatcccggctcactgcaagctccatctcccaggttcacgccattctcctgccttagtctcccatgtagctgggactacaggtgcccgcaaccacacctggctacttttttggtattttttagtagagaccggctttcaccatgttagccaggatggtctcgatctcctgacctcgtgatccctgtgactatttctatcagaatcccttcttgatggcataacaaaggtaaaagcaaagcattatagattcttcaaaaacaggtaaagaatcacatatggatccccaaagtctgtcttgacagtaagaacgacatttctacagatcagctgttgcctgtttgtttatgcgggtaaaatttgtcatggatttttttttttttttttttttttcacggggtagtaatacccctttctaacatctagcactgctggattatgaaaattttatccaaggtgatgtttattctctgaaggtaaactcagactgagcaagacacaaaggagaatataaatgtccttttctgtatttcttgtagaatacatcttgactttgtgcctattctctagtatggtgtctgaaaatgatgtttacccatagaaactatttttatttaaaggaacaaaattccatttaacttttactttaacaggaacatgggtagtataatacattttattaggcattcccctgtttctgggtataattttaaaatgcaaagggggcaataaataaggccctttgtgctatagcatacatcatcaatggctgataattcattccagcacagtgtttggcattcattctaagccaaataaatattctatcttcacaactcatgacaaacctgatgagcctcgcaactcaatgtggggcttccacgcacttccgctgtcatgtgtgaatcaaaatgttgcagagatagtgttgatgttctctacaatccgtttaaaaagacacaaactgtgtgtgaatgtaaagaagaattgatataaatgcagatgatagacagtttgtagctcaagacaactaggatatatgaaatttattctatttctagaaagattatcttttattaacaaatcctgaagactatggtaaaagtcatttatttatttatttatttttgagatggagtctcgctctgttatccaggctgcagtgcagtggcgcgatctcggctcactgcaacctccgactcccgggttaaagcgattcttttctgcctcagcctcttgagtagttgggactacaggtgtacgccaccatgcccggataatttttctgtatttttagtagagaaggggtttcaccatattggccaggctggtctcaaactcctggccttgtgatctgcccacctcatcctcccaaagtgctgggattacagacatgagtcaccatgcccagctggtaaacatctaataatattattaagcaaagacttcaataaaactgatttgcttaaaagtctaagtttatactggaatgaggacaaataatgatagacttctcagcatggtaagcacttcacaaagcttaataaagtgacactttataacatatataccttcacacctctgtgacgtgttcctaacataaatttaaataaatgttatcatttaccttatttttctttcagccccaaatcagctagtatagaagaaaagcctgccctgcaattattcctcatattctacttttccttctcctcctcatggtataagggttttgtaggaaagccgtgcattaacgccgatatgtgtaataaacacatctttcatgctaagcattgtactagcaatgcgaagaggaaaactctaaaatctccatgtaagtgtagggaaaatatgtacaaacatttttacaccataatacataaagtgtaatctcaagactgtttatggttatggttttttttattattttatatccctgataatctgatttaaatatatcccttatctatagccatgccactctgaccatgcctgatctcctctgaaacacacacctgctttgcaatcagggttacacatataaagacaggaaattttttataagaaatcttgtaaacatagttatccagggaaacagaataaaatcttgatgttttctttttcaggtcatgcaaacaaacatttttaaacttcggttttcttatccataaaagaagagaaataatacttcagtatacatttttttaaacatttaaatgagattagctattaataaagattaattgctattattataagattatcaactcaacatcaatattgctggtataagaatatcaaattttcttttatgatttaatgacattgaaactcatgtgtatgtttgactatttaaaattaaagttgaaggaaagtcactgtccttacacgctgaattgtgtctccccagagttcgtatgctgatatattaaatgccattgccacaaaatgtgactgtatttgaggataaagcctttaggttggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgacttccagcctccagaactgtgagaagataactcttgttgtttaagccacctagtctgtggcacattgttatggcagccctaaggaatgcatacaacttccaacaaacacacctacacacgtgctacctgattctctgattctacctttaaaatatatctagaatcattcaaattttccatccctaccgcctttgatttctgtgaaccacaccacttacctcttactacaagagtctcctcctgacattcatgtctccaatataccccttctgagccattctcaacacggcatcatgagtgatttattttaacacaaattttgtccttggccttggctgttgaaaatcgtttgatagcttccaattgctcctagaataaagttacacaaattgctcggaaggctttcaattatctagtttttgctaaactcttcatctcattcctcaaccaacacatctgttgtatactaggcaggctcagcttagtgtctgggttctcttctgcctctagaatttttattgattattttgtgagaggatagacccctttcttaaactcttagcacagtgagttcacatagaatgaaaaaaaattcttccataataaataattgcataaatgttcttgacgcacacaaaatattgtcatattctggtacaatcactataaaattttcattagacaggcttccatttatcacttcaggaccaacaatgttgagaattaagctgtcccatgggaatatatttattcatgtctaatgccttccttaacaaccattagaaggagggaaggaagacagaagaaaggaagaaaggagggaggagcgaaggaaggggaaagaaggaaggaagggaaaggagggaaggaaggggaaagtgggaaagagggggaaggaaggggaaagagggaaagagggggaaggaaggggaaggagggaaggacggaaattatcagaagcaaaatgaatataacttacacactaaatatccccacatataaaaccaaagctttaggaaagcctgagaaaaaacagttatgtttcagattggaaacaaatattaaataagaagaaatgagttttgattcttaaaatatcaagaggaaaatttagtttgcactgttaatagttcaaagatgtttgggataatatatgaagaagaaaccaaaatatttggatattttgcttattagtcaggatattattattgtaataatataattcagtcaccaatttatcatttaaagaattgctgtgtaaactagaaagagaaactgattaatgataggaataaaaatctagttaatatccatttttaaacaatgggatagatgtaactacaaattggcatttttttaaatctaataagaaaaatgttctgataaattgcaatgatttgggatgttttatttagcatatgttagttttccctggattgggctttctaaactattggtgttaagtcaaatactgtggaagtcctagtcattttcatcacaaattgaattcaatttcaaaaaatattatgggtaaaaaccaaagaagaattttaaatggcacttggcaagagaaaaaaaatgaactgactcagcaaaaggacttcctttgaaggaaactttccaaaggacctctcaaaaagaactgctataactatactgttttcttagaaaagatacgatatacacaaaagaacagctatgtgaacacaaaaattgatcacatatatagaaatgaactattgaaccagacttgacagattgtaacttgaacacagtcaggaacacacagggaccatctttttttagcttccagattttatcactatcttgatctgttagtgataataaaatattcatcgctgagcacaaatgaagctgcctgcctgcaacttgactggagggtcccttgaaataaataacataaaactggttctcagcaagcatcccttttgaaaaatgcctctgtgtgttagcaaaccaaagaactggatgctattatattactgtccactacagcaatagcaaacatgctcttcaatgactctcagcaaaagatgcaaaatgcctctaatttacagtatttcagaagatgccaattccagccagcaagagaggttgaatatatttccataaaaatagtgagacagcattttccttttttcctcttattgtctcacaagtgtgctgtgagtcttcagagactacgtaacatcttatgtagccatcaagccaacggctcttgaaaggtgtgcatgtgaattatttgacttttataatgattagtttgttggactcaataatttgtaagattgtgaagggatcctgacatccaaatgtttgacaaactctaggtttgctttgtgattatttacgaatttcagagaacagaaacttaacaaagaaaacagtcacagccactctttctcccaagtactagattaaaatatcatcaaaaccaatattcagcctatatcaatgaaacaaataaatgtgggcacagtgagaaaccaagcagctgtgtatttttacaacatgatcacagttggttggcttttcgggctctaacttcctttgctacttcccttagttgtctgcttattttgggagaattttcaaaatgtggaacagagaataagccattcataacagatgctgtaaataggttatccatttcctcctacctaatagcattagcctcatcttgcctggaaacagttgcctttaattaattctccatgatgcctcttttctggtagctatgagaaattgataaagaaacatggtctaattttaatcaaaataggacgtgtcagtggcactcaggctaaccttgcaggctaactcagacatgttgaatagagaatgcaaacttcttatgctaaatagattaatgaagaacagaaaacaaaagttatcgcttgtgtttaataatgaaattaaatatattgtcaaaatagagagtattttaaaaggtaattttcactacagaatataacattgtttttccttttaaaaatattatggtagtgtttaatattccatttgtattatgttttctttgatggttacaagatttgatgttaatggaactggttggtttgtaagatacaaaaaagacaactgttaattgatcacatttttataagcagtttcaatataaattcatactgaaagtaacttcttatatagctgtaagacaagagatcacatcgataaagatactgtatttcacgatgttgtattttatataaaattacactttcctaaatttctcaaggaaaatctaagccttataatccaaattaattttccccttacattatgtcagaaactcagttagtgttattttaccttttggatgccttacattattttttttaattaatttatttatttacttgagatgaagtctcgctctgtcgcccaggttggagtgcagtggcgcaatctcggctcactgcaacctccatctcctcggttcacgccattctcccgcctcagcctccagagtagctgcgactagaggcgcccgccaccatgcccggctaatttttttttttttttttttttttttttttttttttttttttttgtattttttagtagagacgcggtttcaccgtgttacccaggatggtctcaatctcctgacctcatgatcctcccacctgggcctcccaaagtgctgggattacaggcgcagccttacattttttttttttttttttttcaggtctctaactgatgggttttccttttctcctggctatgccataaactaaatggcaagatgcaggtttcagaatcatacacttcagagttgagatttacacatttgagttgtggcaaagctggggcaaggagtcagtgttctgatacctgctctggcactttgcctccttacgtccagttctgagctctcagcctcaaaaacaccttctatcaaaaaaacacagaacgcaggaggaaatgcctacaagtgccttcattccatccactaaaaatgtacaaaatctcaggagacatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggccaagtcgattctcaaaaaaagggtgatatcgtttggaaacatgaacttggagaaaacctctcccaggaccctcatccactcgaggcagtaattcgcgtagtgcagtcggcacagtgccatagcctctgcttggtgtctgacacatccaaagcaggtggattcattctgataagcttcagcccaacatcgacttgcagagctggcaattcggggttgataatgtggcacagcagactccaaagacgtgtacccaggatgtgtctcagcagtaagtgtagagttaacaatgttgaaaaggctgtttacccagttcctcagacgttgtgatgtgcacagtgtgtgttctctggttaaaacaccacaactccagggaaggaagctccattattatctgtctaaatgtttatatggacacatttttttttttttttttttttttttttttttttttgagacagagtctcgatccgtcccccaggctggagcgcagtggtgtgatctggactcactgcaagctccacctcccgagttcacgccattctcctgcctcagcctccagaggagctgggactacaggcgcccggcaccagactcgactaattttttgtatttttagtagagacgagtttcaccgtgttaggcaggatagtctcgatctcctgacctcgtgatccgcccgcctcagcctcccaaagtgccggcgtgattacatgtgtgagccaccgcaccggccagacacactgaactttaaggaagtcaactcacctcaccggcatcaggcatcttcatcaggtaagagctccgccagcacttcctgtccatccactcagaggccaggagagtcagagatcgggggttttctgggcttttccttcaccctcctgccctaactccagctgtcctcactccaatgactgtttagaaccatcccctcctgaccaatctcttcctcagttaccctcacatgattcttcttctactctccccccctgcccccaccaccaggcaacactccctcacacaactactgaaaaagaaagcacgcatgatttgactgctgcctacctcgaatccttcagcggctcctcctcacctgcgtaattccatacaaagttcccagcggggaaggggaagccttctgtatgctcacctgtctattgcgccccacccttcttccctcagtcctcagtggctgtgctctcctccacactgccttccccacatgctgccctgtctagaatggcttttccacctaccttctggaaagtcccacgcctcatttcaataccctacatgattgcctttgtgctcccaccacaatctgttcctgtctccattagagccctcctccttaggcattttaattagtcatgtataaacctgtttctggataatgataatgaccctaataaataatatcggttccctaatgcagctggacatgtggcatgtagtgcatgaaggttactctgagtgctggctcatgggaaccccattctttgaaatatctgacatcaccatggtcaggtttcagatgcagacactgaagctcacctaggttaacaacccccggcaagccatggacttgccatgtgagatcagagcctgacccaatgtgccgactccaaagccgggcaggaagacacatcatcagaaagacttctctggtctggaaatggtagctgagcttcatggaatcaggggctgcatgtgattcttctcaaagcctcggaggctcctgcagcacaaactctggggtgcaccaggtagaaacccacagaagatgcaccaaagccctgagtagaggttaggtcttaaaaccacgggttccatgattgtttcccatagtctgttctatgacctttacggtaaagaaatatacaagcaggaggaagacttttctcttgaaaaacataacacagatggcatctttgatgcgcgtgacatgctctgggtgaagctcaacttagagtcaataacagctcctgcctaagtcagctgggaccactataactaactgtaagttataagttgctatagactgggcaactttaaaacaaaatgaaaaactcagcaaactatcacaaggacaaaaaaccaaacaccacatgttctcactcataggtgggaattgaacaatgagaacacatagacagaggaagggaaacatcacacaccggtgcctgttgtggggtggggggagggcggaggaatagcattaggagatatacctaatgttaaatgatgagttaattcctgcagcacaccaacatggcacatgtatacatatgtaacgaacctgcacattgtgcacatgtaccctaaaacttaaagtataattaaaaaaaaaaacgcattggctacttggagttctggaggctgagacattcaagctctaggagaccagctgtctggtctggtgagagccttgtgtgtagacagtagctgctcctggaatcctcaccttgtggatggcagagagaggagcgtgccctcgtgtctcttctagtaagggcactcagcccacagcgagggctccactctcatcacctccttgcctcctaaaggctccacatcctaatgccatcaccctgagtttagaatttcaacaggtgcattgggaagggatgtcatgattcagtccctcatgctgcctttggcttgtgtcctgggaaagatggcacatggtcgagagacacagcctgcattccattcccaacatagttcaccatcatctgcacttttcagactacctaacttcacctgtaattaaacatttcatattaacttttttttttttttgagatggagtttcactcttgttgcccaggctggagtgcagtggcacaatctttgctcactgcaacctccacctcccaggttcaagcgattctcctgcctcagcctcccaagtagctgggattacaggcgtgtaccaccacacccagctaatttttctatttttagtagagacagggttttcccatgttggctaggctggtctcgaactcctgacctcaggtgatccgtccacctcggcctcccaaactgctgagataacaggcataagccactatgcccagcccgtaattttcatattcctaaaaaaagtaaagataagctttcacatattcactgagaatttttaaaacatcactccagtttgcatttctaaaaagatacactttggtataataaaaccaatatatcttaggtggtaactgccatagctctgagcaatatttgaacggtatttctacataagggccaataaaaggaaatcttccaatatatttgaaggattactctatctggaatcttgactgtaaatactcagggaactaccatttcaatactaaccaaaaatatttaattctaagtacagatcaaaatccgaaccagatttatgctaaaagggaaataaacaactggtccttctgtctgtagaatcatcctagctcaacacctacagaatggaggatgctaagtgctacactgaaggaataaacaatgctgagtgatgctgagctccaacagaaacattttccaaataacctcaactccaagcatccagccaggccttgctggatgtgtcgtagttgcttcagggaaggtcacttgagaatttcctattaaaataccactttaattggttcattctctttataaattaaatgcataatgattatttgtaagctgacccaggtccactctaatgttcagtaatctacctcttggtgttttgttaaattgtgaacaacaggaaattctgtgatgtggtacacaaagttcagcactgtcacagagaagtcagagagactgatggatgcctttaaaatatcctcaacgctgcacgtaaaaggcacgtgttgctgtgggtgaagaagttaatgtaagtaaaatgaactcgtttgttttttaagggagtgtattttccacattgtgtattttaaggaataaactgtgatatcttgaggatagacaaaatccaggtatgtcctgaggcatctgtcttgtagtcacaggatcggccccaggaaaacagggccatttttccatcatgcacctccctccagcctgcattccctttccccagatgtagaagtctccaagcttcctcagctccctgttaggaaggacatctctaaattctctaacccgtgccattctaactcagtgtctgcagctgtcttttgtgcctggctacctttggaagtaatgtggactctcttatctttggatggcaggcttttgacaacttcagtgccttttaccggggcttagaacttcagctaacagaatttttcacaacagagatatcttctagaaggcagaatttctctttctgttcttccaagtgtaatgaattaacatgaccctgctgaaggattcataactcaggtacaggtaaaacaagcaaacaaaccaaacaacaagcattaactgcaattccaatattcttccagttttccaaatggttagggtgcagataaggagtgtttagcatttggtttagaaccttagggtgtggaaagcagattcagaatgcagattaaaaaggaatttcaaaaaccaacctgctttatctaaaaagatcatttaaatgtgtagtttgcgcacttgcagaggtgttgggagaagacagggagggacagaataaccttaacaatatggattataaatataaaaaaatgtcctgctgagaaacgcctgagaaagagcaatgttttgttccctctcctgtgctttaattacagtctgcaacgtccaaactttcagtaaaagtcttccagatacaggactagacattattttggagaaatgatgcaagagaaattgtgtcccatatgcagacgtaataaaacggttgaggagcctacagctaagtttacgggtggtgccagggtgcaacttgcatccttctcccagcagaagatattaggatccctgttcaccaaatacattagaagagccaatctttgaaagcaaaggaattcaggcaaaatcctttctgttaccataacctcttcttgtaatatcaagtataaatacggtgaagtttacttggaaagctaaaatattcagactactttagaccatgcatgtgtaaatcatttgccttgttatagatcctaagatcaatgcttcaagagataaatcacttatttacagtgagacattaactacaattcagtttctagatcctgctgaccaagaaaaatactctttaaaaatataaataaattctgagacatttgtaattgcaataagatattgaatcacccatatctagtttaacaaacacattatacagaagtgaaccaaatggaagattttggtagtgaaactttatcatagacttataccataacattaaattaacatggggaattaaaatgttatccttgtcagatatgtttctcatggattgtgacatgtagtttcactttgttatcaagaatctgtggcatcattattattatgtcaacattataggtgaaaaaaatccaactgatttcctcaagctcacacagataaattaacagcgggtaaatactagaggaagactgtagctttttcctagtgccacatttcttctgcaaatgcttattttatatgaaaaataattgttcgaagtttttttatatatatagcatgaatcaattatatttccatgtaccttttctattgcaggcacacattaaatattagagggcagagaagtccatttgtctatcagcagagataagttttgcctgcataaaatcaatgggaggtgtaagcagttacaatccttcctgcttgtggtttgctagggggtcattttaacgtaatcaatgtgtttagctcgataccttcatttgactatgctttaatttttttccctttattaagaactttcccaaagtccagatttatatgggtaatatacaggaaattgtatagaaaaatatcaacgataattgtttgaaattggataatttataaaactgtagctaacatagttcttacatctttggagaagaaggaacaccatacactttcaacattattcccactttctcaagagaatgctctatgatggtaatatagaaatacgatggttaaaaatctacttccagttataaatcagctttttgaattgaatatttacagaaatcaggtagacacgtaagcaggaatgcttatgtactaatgtttttaaaatcccttacttaggccaggcacagtggctcacacctgtaatcccagcaatttggccaaggcaagtggcttgcttgagcccagcagtttgggccaaggagtatggaaaacactgcaaagccctgtctctacagagagtaccaaaaaaaaaaaaaaaattagctagtcatggtggtgcacacttgtgttcccaactccttgggaggcttaagtgggaagatcgtttgagcctaggaggtcaaggctgcaatgagtcacgattgtgccagcgcaccgcaacccaagcaacagagcgagaccttgtctcaaaaaagaaaaaaaaaatcctttacatatacacacacacaatagatatatacgtccatagtaatatatacatataatcaaatatatatgcatgcatttttatgggaatatacacacatacacgtatagtgagagagtagggaatgtatgtatgtgcatgtgtatttatggagaaatgagaaattaacatcaaattagacttaagatttttctcaaaaactttatgaaaggtgtatactctatcctcttctcaaaatcttagaaatggtatttgccttcatttttctgctatgacaaggtgaacaaatctcgtagcaagtgcataccatttattacaattgtaaaatgacttgtaacgtgttattaacagtttttgaagggggtatgattctttttcagatgtgtaattaatgtagccgtaaaggaaaatggcaatgttgtattgaatactgaatcttgactgtggtgaccatgccaggaataagataagcagagcccagttcctgctttgccgctaactcagcaactcacccaaggggagctggagagtatgccagaaatgatacatacggctataaagacagagtgtccaagtttgactcagttcatctccgggctcttctcacttccgacattgccccgttttgtgaacttgactgtgtctctttctacattctggaagcaacagtgtaatactctgcagttctaggttccctagcctcattcatgctgttgcctgtgccccgcacttagcagatgagccagtggataaggttctgcagctctgcttcccagtctttctgacatttctgctcacaattgttgaattacaaagcaccagctggtccctcgtcagcagcggcctccacgcaatcatgggaaatgctgcattccgtcacagggtgccctgagatgtccctgctctgtttcctctcttcaccttgcaaggcagctgacatcctttattttctcataacgtcactgcctggaatttccgcttccatcaatccggcagtcccacagatataagaacccatgcagtgggcacggtttcagtgtggtgaccctgtgctctaaaaccctttgtcaggggaaacacagtttttatgtatttgtgtctgaaacaaaaaatgacggaacgtcacatgcaagtggtgaccgtagctatgtggctttcctgactcatggcagcaaactaacatctcagattccatcatctaacccagccaacgaggcactgtggatcctgctttcaagtgttttctgcattactgacagcaaattactgagaaggcagaatccaatgatagctttccatcctcattttgcaccgtattttcagcttgctgccacatttgttttcctaaggaggtaataaataaattggaagaaacactgaaaatacagcaaagagtcaggagtctggcttcacaatctgcgacagctgagggtgagatatacaattttacacctatgataggagatctataaccttagatgccacatctattcaggaagaataatatcaaggttagtgtaagcatacaatgaaataaagtttctggcaaacagtaatgctaaaaaataaataaataaataagatgtttctgttctcagcttcctatttaagttgaaaggatgtagtccaggagtattcagtcaagcaaatgtccatgttttgtgacatatatctctaatctattgtataagtatagacaaaggcatttagcagatgccactttattgcctcaaagagctgaaaatcaatgggtatctgtggaaggagaatggtttaccccaagttcaaaactgtgtgcagacaagagccactgtggagaaagagcagaagccaggacactatgcttctaacgccgtgagctgggccaagaggtgaggtctttggcaataggaatgcatgagcctacaaaaggcctaagtaaaaagttttaaaaaaggaattgtattctagtcccttagttgataacctgagaattctcattaaaaacgtacaaggaaaaagagatcatgtttgtagacctaccttatgcaagtaaggctaatatccccgtaagatatgaatatcactgatcacagagaaaataagagaaagactgaatgttggaaagagaggcacgattataaattagtgaaagctttctgatttgttgataccaagtcagctgcatcacagtccacaaatatttgttgaagtgatacatttttctaaattccaagtctattgacaataatacaaaatgttatattgaaaattaagtgggctaccctaatgctactccagaaacacgactgcaagtttctgcagtgataaacctcatcacagaacctaacactgctgcagaatttgtcctgttccaggcccgatttgtgctttgaactcatgcaatgcctacagtggccacatgacgcgcatgcactattgttcccatgctacagatgagataaaagaggcactgactgtttacataatttgcccaggattgtccttttgcagtttgtaacagagccagatgactgggtcacgcaaatgttgaaaaggggcagcagagaggtgaataagtccgggtgtgaattagggggtggagcagcaagatcagcgtttgggtctcgcattagagtctcacctgcatgactcccgcagggtaaacagccacgctgcttctaatgctctgctgtagatcacattccttttactttataaatcagaacttgcctctgtttggcaggaaccttgtttgggaaatgaaaatatggtaagtatgtgtttccttctagttaaacaagggaaagtatcgttcttaaacgccaaacttaaatggttaaaaaagttaagtcttaggccatgtcttagaacgaacgttcttatctttaaattgtgagtcattttttcagatagagacaaggtttgattttttatcactcttggttagctgatgacataatacacattcaaagaaacgtgacagattttaagcaaatttctaatcaacagtgttctacttcgtcaaatcacaacagaaacattcctccgtgtcagcttttgtcattgatccccggatctttccagtaatttgtgtattaagagccacaaaggggaatacacaaagctgcaaagtcaattaaatcctcttaaataaggcaaaatgaaacaacaaaaaagtgccatcctatagccctctctgttcccagtaagtgcgggaatgagcttttgaggaatgcacagcccaggtgttctgcagctgcacattttaatcatcaagtcaccaaagtctgctgataaacatcaaaaaagcctaatggagtcacagacccagtggcctggttcctcagatgagctccatagattcctacagaaatggaattggaatagggctggctggagttatcagagcataataatcatccgatcctgacattaagagtccctctgcctcacaccacccagaggcaattcgttgtgtgaggggtgtgggaacaaggtttcatatctggactgggatcactgtgatatccttggggtggtagcaaaatctttctttttactaactttttaattatggctaaagagttgatggggttgaaaatgctttctccttttcaatgaaggctctgaacggccgtgcaaagtttatgttctctctggttttgataaaacttaaatgaatgcagaagccaatggcaagtccataaaatttctcaatgagtctctgtactgacttgagaaagaaaggataaatatgctattggtgctaactcttttattgagcatttttatgtccaattctttatcttccttatgtgtaataaagtaagttcctcttatttgacttactaaattcaaattctaaaagatcacttctatccacatacccaaaagcattcagttagtgacaatattaaaaacaatgggaaacagtagtttttgctatttggtgataccaggtacccatctgcttgtgatttaagataattttctgtactgtcaggggcccaagaagagactatgtgcagtttgcagtggggccagtgacagcttcaacctttgaacaggaaatccagacagtacagacttttgggaagggcccaaattacagatcccagcagcgagcagcaagtactatgaacacaatcacagggaggctttttaatttatctgagcttaagtctcctcatacataaaatggagtgcatttttcttacctctccggacatttgtgagggttacgaaactttatctatccaaccaactttgcaactgcttggcagatgatgcatacatcccagatgatattaagtaggggtggtggccaggcattgaggggcatgttatgcacacaaggagcctgtagaccagaacagggatggacccgccatggccagggtgacaaatctcactgcctatcttgtggaaaccctaagagtgtattttatatttttaagtggtagaagaaacatcagaagaagattttgggacaagtgacgatgtatgaaatttacatttcagtgtccacagaaggagtttataagaacacaacagggcccgtttgtctacatcctgtctgtgactagtttagtgatgcaattgcagagctgggtcactgcaccagcaactcagggtgggcagagcccaagatatttaccatcattttctttgaagaaaatgtttattcacgccagctcaaaggttgaattgaaaattttctattttcgtcctttttctttctctattttcccctacctccttccctccctccttcacttccttccttccttccttctgactagcggagaaagaggctcaaagaactggttaaagcagctctagctacctctagtcaatgactgtgttgtcattcccccgtattgctaagaccctctgccggtcatgtaacaaatgcaaatctttcacgcagagttgattttcagaacagctcagacctctgttatctgggcatggggtgagggcatcccctcacgcccaaccggccttgggtgggtctgcacagttgtccctctggccgtccttttcctaggagtcagggccagggctgacctgcctggtccagcgttcacagctgggtgaacttgcccagggccttggtccagctttagtcagtctcctatcctccccacaggaaaacaggatgctgaagttgggcttggtcctatcctccccacaggacaacaggatgctgaacttgggcttgtccctgaggttaagcaagctgtaaggttcagaacatcttttagcaacgtatgccgagattggccaactgttgctaggaccctttcctgctcaactgcccccatacacggaaccaatgcctgctcaaagctcctgctacccctacccctgcttccccattacaatacaagaaaacccttttttttttttttctgtttgagcttaagatccctgcagtccctgaggtcagaccattctccctacggccttcatcatttttagtgaagtctctcctttcctaagcccagacatacttattttggcaccattgatgctaggacggaggatcatgcccccatgccagctctgcagacatcgggaagactaaacaacagaagtacatgtcaagcccttggaggaaggatgcaatcatctctactgcaaaaatacattgcaaagaaaacccgaaagaaatagtaatatgaatacagccactagtgcggtcatcactattgcaaaaggatattgcaaacaaacaaacaaaaaaaaatcaaagaaacagtaatactaatacagccgctagtgcagtcatcagtatggcaaaaggatattggaaaaactcccaaagaaacagtaatattaacacagccgctaggttgtgtcctaggttcactatgacagaacagtcctcgttcccctccttcttatttttctggcccagaaatgataattttcacagtggcgttgctggtggtagtggaagatcaacgccgtaataatgagtattatgggccagcagctattcctaaaccaccccattcagtccttatcacaaccccatgagaaccaccatcatcgtcacttgatgggtgtgaacactgaagtgttgggattttagaactttcccaagtttatcatatgggatgatgtagaatccaataataggaagtcagttttcagaatctgaaatctcaagtcctcagtttactactgtttccagctgaaaagaaagattatctttctataattattatttgttttttgagacagtttcactcttgttgcccaggttggagtgcagtggcacaatctcagctcaccacaaccttcacctcccagattcaagcgattctcctgcctcagcctccatagtaactgggattacaggcttgcaccaccaggcccagctaatttttgtatttttagtagagacgaggcttctccatagttggcaggctggtcttgaactcccaacttcaggtaatccacctgtctcggcctcccaaagtgctgggattacaggcatgagccaccgtgcccagcccgtaattctttattgatagataaccgtgaaatgttttactcattggggtagcatttagtgtaagtttaatttatacctcaagtattttaaaagctaaattaatgtccattattagtactcaaatggaggaaatatttttatttgtgattcagtaatcccactatgtgatatctaccgaggggaaaagaagtcattatatgaaaaaggtatttgcacatgaatgtttatggcagcacaattcactactgtaaaaatgtatccatcaatcaacgagtggataaagaaactgtggtatatatatgatggaataccactcagccataaaaagcaatgaattaatggtattcacagcaacctggatgggattgcagaccattattattattattgtgagacagagtctcactctgtcgcccaggctggagcacagtggcgcgatctcggctcactgcaagctccccctcccgggttcacgccattctcctgcctcagcctcccgagcagctgggactacaggtgcccgccaccacgcccggctaattttttatatttttagtagagatggggtttcaccgtgttagccaggatagggagaccattattctaagtgaagtaactctggaatggaaaactaaagaccgtatgttctcacccataagtgcgagctagcctatgaggatgcaaaggcttaagaatgatataaaaaactttcgggccttgaggggaaagggtgggagggggtgagggataaaagactaccaattgggttcaatgtataatgctctggtgatgggtgcaccaaaatttcagaaatcaccaaagaactttcatgtaaccaaataccacctgttctccaaaagtatggaatttaaaaaaaaaaagaaaaagcactgaggacattaaaaaataacgtcttaattccaagtattaactttgaaaattatgatttactgactaagacttaaggggaagtatttgtcttttatatagcaaaaatctggctaattgttctttctaaagtctaactttatcataaagtaacacaaaacattctgattcttggaaagtactgaatttaggaaactctccagcaacaagcataaaaataaaataatgattgaaaaccattttttgtaaagtaatgaagccaactttggaaatttggtgttatgttgacatatatatacgcaactttaaattcaatgaaatagtccagaataaagaatatatttcaataaagtaagtgttggtcatgtgtcttcatgaggtccgaacatc

SEQ ID NO: 93 - DNA, 1088 bp, Homo sapiens
acgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtcacatggatccctctgccaaccttccctgcctgcgagccgggcgagtgaagccgagcgcggaggcgagcagggacccctcccctgcctctggccgctggggcgctctgcagtcttaaagcagcagcagagacgtgcagccgaactgaggcaggaccggggagagcgcagccaccgcacagtcacgcacagtcatcaggaggaatttcttagaggcttaaataatcatttcaacagctgcttatttttagttattttcctgccggttgctaataagggatggccggggtgactattgcggaaggtggccagccacggagaggtgaacatgaaatgctcgtagttttaataaaatgtgcagctggattccgattccgtatttactctcagaaaagtccagttcatttgcttagagggaaatgctccttccaaatccttgctgctactgtaaagatctctatgatt

SEQ ID NO: 94 - DNA, 2294 bp, Homo sapiens
accttctttcaactctaccttttcttagtcaccgtttttttaaaaaattgacaatgctcatgcatttcttctggcctgttggtatgctgattctttaggcactgtctaggtaggcaaagaaaatgcactgccttgcagccaacacacagagcttccctgtgtgtcttccaggaaaatcttagagcctcccctttgcttctcgtattttctcacaagggccagatttcctctcttctcttcttttaccttctcttcttctcctctctctctctctctctctctctctctctgtctctgtgtctgtctcgctctctctccctcctctctttctctctctctctctcctctcttctggctaggggattctgcttaatggtttaatttcaactgtcagtaggttatacattttatgcagatgtgtgttccaaaatttgaaatgggaatttaagccgtagctactcccaggcgatgtcaaatgatgacaatttcctctggttcccacaagagaggaagccattcatacatgtaagttcatatttatgcggtgacaggcagcctaaggtgcagtcacacttactaattgggtctgactcagtcaagagcaatagctttctaaatacccaggaagaaatcatttcaaaatataatattggctgggcatgaggaaatgtatgctatttacaatattcactgatttcatttttacaactatacaggtgtttttttttttttaatttgtcaacatttcagatgatgtaatgcttatcagtgcatatttttacataaacgactgtgaggagcatgaagcagcacggggtgcatagaaggacagaacattcttaaagccctccttggtgctggagatacattgtactagcatgaaattacgtgtttgaaaaatctcaaaaagcattgaatctgaagggagatgttcctcattgacccctccacttgcgtgcacttggaatgtcacatccctttccaggttgtaatattcaaagtggcaatcttcctgtctctccttctgtcaccaaacctggtttattctgaatgaggcagctctctagtactggagttaggctctgagctgtcacttggctaggtaagcgccttccaatgattacagagcaatttctcccgggcctctccattgccacctcttctcccccaaaaaataaatatgatatttaaaaaataaataaaagcacgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtcacatggatccctctgccaaccttccctgcctgcgagccgggcgagtgaagccgagcgcggaggcgagcagggacccctcccctgcctctggccgctggggcgctctgcagtcttaaagcagcagcagagacgtgcagccgaactgaggcaggaccggggagagcgcagccaccgcacagtcacgcacagtcatcaggaggaatttcttagaggcttaaataatcatttcaacagctgcttatttttagttattttcctgccggttgctaataagggatggccggggtgactattgcggaaggtggccagccacggagaggtgaacatgaaatgctcgtagttttaataaaatgtgcagctggattccgattccgtatttactctcagaaaagtccagttcatttgcttagagggaaatgctccttccaaatccttgctgctactgtaaagatctctatgatt

SEQ ID NO: 95 - DNA, 2046 bp, Homo sapiens
gcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaa

SEQ ID NO: 96 - DNA, 1132 bp, Homo sapiens
aacagagaagtaacgataggaaggatgaaaaacaaatcatacaaagcataaaactggggccagggggcttctgtgcagcacagaattgctaaaagaaacagatgcttcccaacaattaaaagttgagtattccttatccaaaatgcttgggaccagaaatgtttcaggttttggattttttttttttttttttttttttttttttttcagatttggggatatttgcatatacataatgagatatcttggggatgggacccaagtcaaaattcatttgtgtttcatatacatcttatacagatagcacaaatattttacacaatattttaaataattttgtgcatggaaaagtttttgtacattataccagatgtggaattttccacttgtggcatcatgttggccctcaataaagtttcaaattttggagtgttttggatttttggattagagatccaaaaaaagcagtccccaacttatttctatatccagttaaagaaaccatattttaatgagagaacaatttgcccaataacctaacccccaattgttccttatttcataagtcacagtatgctttagggcaaatattcttaacttttccttaaagatggataataagtttctgcctgtataatcctatgtaactatataagcaatgctgcaatatactagttatgggaaggtagtgtgatgtgatgtaacaacagaagttaacacttgctcagcacttcttatgtgccagactgttgaaagagctttactaattcatttatttcaaccatcctacaggttaggagtggttattatctacattttaacagatgagaaaatgttaagtaacttgcccaaggtcacaaaattagcggagccaggatttaaacctaggcatagaaagagcatgagctttggattcatacctggtgttcaaatgtcaactgtgtgatatgtactacggtaattaagcttttagaatctagtttcctcatttgtaaaatggagatgaaattactgggagaattaaatgcattactgtatgcagtcatgcacttagcagtgcctggaatactgcaagtacttaataagatatatgctagttagcaataaatttaaaattaaagtttataaattc

SEQ ID NO: 97 - DNA, 10608 bp, Homo sapiens
ggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctc

SEQ ID NO: 98 - DNA, 12580 bp, Homo sapiens
ggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtac

SEQ ID NO: 99 - DNA, 110791 bp, Homo sapiens
gctgttttgtgttatggttgagagttaaaggtatgattgttctactgctctaacttgttttaattttaatgctaaatacagttctgaatacagtagttataacatttgtgatactctgtacatacctacatttatgtttgtgtctgatatcagagataaaaggagcacattttagtacaatctggtccttacattcaaaagcactaatttctttgtctccttcattaaaagctattggttttcaaaacatcaatgcgttttttagcaatgttgtatttcatattgggtcagtctgtcattcggctctattacatgagttccgaaatcatttaggattctctgtttttccagattttgagaatcagaacgttcttttttagttataattaaaatggtagtatcccattgtgggatatattttccattccatatcggaatattgaaaattcaggctgggtggctgggcgcggtggctcacacctgtaatcccagcactttgataggccaaggcagttggatcacctgaggtcaggagtttgagaccagcctgaccaatatggtgaaatcccgtctccactaaaaatacgaaaattagcttggcatggtggtgtgtgcctgtagtccagctacttgggaggctgagacaggagaactccttgaacctgggcggtgaagattgcagtgagccaagattgcaccactgcactccagcctgggtgacagagcaagactctgtctcaaaaaagaaattaattaattaaaaataagaaaaaaaattcaggctgggagtggtggttcacacctgtaatcccagcactttgggaggccaaggtgggcagatcacctgaggtcaggagttcaagaccagcctagcaaacatggtgaaaccccatatctactaaaaatacaaaaattagccgggcgtaatggtgcatgcctgtaatcccagctacttgggaggctgaggcaggagaatcacttgaacccgggaggcagaggttgcagtgagcccagatcttgccactgcactccagcctgagcgacagagtgatactccgtctaaaaaacataataataataaaaaaattttaaatcagtctgaaaaattcacctgagtataattacttgtgggttgatgatgtacctacatttagacatgctacaaattcttaaatattgttcaaagttggctgggcacggtggctcacgcctgtaatcccagcattctggggggccgaggcgggcagatcatgaggtcaggagattgagaccctggctaacatggtgaaaccccgtctctactaaaaatgcaaaaaaaaattagccaagtgtggtggcgggcacctgtagtcccagctactcgggaggctgaggcaggagaatggcatgaacctgggaggcggagcttgcagtgagccaagatcgcaccactgcactccagcctgggcaacagagcgagactctgtctcaaaaaaaaaaaaaaaaaaatatcgttcaaagttgttgagagtaaagacattgaatcacctctttgtgtgcaattcataaatctataaattcataattttatagggctatacctagagctttaatcatatatacactttgcagtcaatatggtaactttttgaagtttaatagcaacaaattggctggacggagtggtgcacacctgtaatcccagcactttgggatgctgaggcgggtggattgcttgagctcaagagtttgagaccagcctgtacatatgatgagaccctgtctctacaaatacaagaaaaattagctggacgtggtggcacgtgcctgtggtcccagctactcgggaggctgaggcaggagctgattgcttgagcccgggaggtccaggctattaacaacttcactctgatttttgagtgcctgttaggtaccacgttttatgagacagcccttgttacttcattgtcctgctgaggaagctgagatttaggaaccttagctgagaggttaaggaacctcttccaggtcattcttttttttttcttttttcttttttttttttttttcctgagacgagtctggctctgtcgcccaggctggagtgcagtggcgcgatctcggctcactgcaagctccgcctcccgggttcatgccattctcctgcctcagcctccttagtagctgggactacaggcgcccgccaccacgcctggctaatttttttttttgcatttttagtagagacggggtttcaccgtgttagccagggatggtcttgatctcctgacctcatgatcggcccaccttggcctcccaaagtgctgggattacaggcgtgagccaccgcgcccggcccaaggtcattcttttagcttgtatttattgaatgctttatgtcatacactgttctagatggtagggatgcaggcgtgaacaagataggccaggtcaatatgttcgtggagtttgcattctagtataaataaatgttttatgtgatattagctatgaagaaaaaagtaaaagcagaatgatatgaggcgttacactaggccagttagtgtggaaaggcctctgtgaggaggtaacatttgagccaagactaaaatgaaggcaggaggagtcacataattatgtcaaaggcagctctctatcctagggctgagtgtgtaaagctctcctattattctgtgatcattacgggaaatcccctattttggtacataatacatatctgaaaatgaaagagccaaaaaatacaatcagccgggattagaatttgaacagaagctgcctctcttctacccgggtaacctaaaagtgggggatcggaatggtataagtcccaggaactgtggggcaggaagtgagtgtatctattgctacgtaacaagttattccaaaactctgtgacttaacaacaacaacaatcatttattatttctcgaagtttcctttggtcaagaatttagacagggcacagtggagatggctttttcctattccacaatgtctaggccagtggttctcaaccatggccacttatcccctcccacctcccacctggggacatttggcaacgtctggaggtatttttggttttacaacttggaaattgcaactggtgtctagagggttgaggccaggaatgttccttcacatcctacggtgcccaggagacccctgcgcacacataaaatgaagaattatctggtccaaaatgtcagtagtgcagaggctgagaaatactagtctagggcctctgctggaagactcgcagagtatgggctggaatcatccgaagtcttgttcactcacgtgtctggcagttggtgcaggggttgtcaggaagaacacccacagtgacctcttcatgtgacgcaggcttcctcataacaggatggctgggttcccagggcggaagtcgagagaaaaaagagcatgcacacatgcgtcagggctggaagtcatactgccttttgtgacctagcccgtcactttgtattctgttggttgaagaagtcacaaagtcccaccctgatttaaggaaaggagaagtagatttcacatctttatgggaagtggcaaggttcttgaagatcacacaggacttgaaatattgccatggccatttttagaaaatacagtctaccacaccaagcaaatctcttcccatcaaagaggttaaggagccaactcccctgggtgaccctcactgtcccttgcacgtgcctgtgccagcataatggcttactgctggtgttctgtttgtcccgtgtgggaagaagggacaataagaaaagtgtgcgaataaggagtaggagtgggaaggggatgctgggtcagttaaagtgatggtgccatcatgtcctggctctgcacaagcaacagtgtgtggctaagcagtgggcttgggttggcaaggaagcattctgactccaccaaaggtagttctacccagcaccctgatggagatctatgaatgacagaattcagtctgcaaaagctagcttaggtttattatgtgctgaagtgtgagtcaaatgaaaacccagtgtctggaagtcaaggactgtctgtagaacacctccttgctgtgattattttaaccacgatcatctttcagacttaggtatagagtgtacagggggctgttaactaaatattttggcttaaatatcgagggtttttttttgtttgtttgttttattaagaatagcatttattaacatttagcatgctttgttttgtttgttgcttctacaaaatagcctatcttggagaaatgcaaattttatatttcatttttgtgttttagattttgctaaacatgttgactttctagaagccataagtagtgctttgagggcccttttgcaaacaatggcctccaagaacatttcccaggtaagagttttaaaattttttgtatgaaacttgtaaagattgtgtattatggaggcaaaattcattacttcactattttaaaaaatacatatttctgttacaagaataatatgtgatctttgtaaaaaataaaacaaaagtgattaaaataaaaagtaatatctttctgctccctaccatcagcaacacacaggtgcttttaatttaattttttaaattttttaatatataggcttactagcaaaacaagtgctttttaatcaatacaacttaattgatagatatgttgtaaataatttctctatcattggtcttttttttaaatcttttttttttttgagacagagtcttcctctgtcgcccaggctggagtgcagtggcatgatctcagctcactgcaacctctgcctcctgggttcaagtgattctcgtgcctcagccacccaagtaaatgggattacaggcatgcgtcaccacaaaatttttgtatttttagtagagacggggttttgccgtgtggccaggctggtcttaaatgcctgacctcaagtgatccacccaccttggcctcctaaagtgctgggatgacaggcgtgaaccaccgtacccagctttttttttttttttttttttaacatttcattacagactttgcaagcatgccctcctgacccttcacagcaatccatgtgcacttcatctcccataggtgccttaccacttttgctactttttactaaggagacttttaaacattcctaaaagcagagataataatgttgctttgttttttgagacggggtcttactgtgttgcccaggctagtctcctggattcaatcctcccacctcagcctcccaagtagctgggattacaggtgtgcgctaccatgtccaaagcagagataaccctatgagcctgcatgcaccgtcgccaagcctcagcaggttattagcgtcctgtcattcttgtgacatggtttcattcatctcactgggtccttatttttgtttcctggagtattttaaagcaaatcatattagacccatcaatattttattatgtagttcagtatgcatgtctgacagaaaaataaatttttaaaaatcttaaccccagtaccattaccccaaggctccaaattaacggatatttcttattatcctttggtttgcactctgagttcagttttcccagctgcagtctaagttcagttttcccagattgccttaaaaatgtattttaacatggccaggcacggtggctcacacctgtaatcccagcactttgggaggctgaggcgggcagatcacctgaggtcaggaagtcaagaccagcctggccaacatggtgaaaccccgtctctactaaaaatacaaaagttagctgggcatggtggcgcactcctataatcccagctacttgggaggctgtggcaggagaatcacttgaacctgggaggcggaagttgcagtgagccaagatcatgccactgcactccagcctaggcgatagagcaagactccgtctcaaaaaaaaaaaaaaaaaaaaacagaaaaagaaaaaaacgtcttttaacagttggcttgttcaaatcaggatctaagcaaggttcatgtgttgcttttggttgatattttggtctcttattatctctaaaaaaaattttactgagatttgattcacataccatgcagtttatccatttaaagtatacagttcaggccagctgcagtggctcacgcctgtaatcccagcactttgggaggccaaggccagtggaccacgtaaggtctggagttcaagatcagcctggccaacgtggcgaaaccctatctctacaaaaaatacaaaaatcagccgggcatggtggcaggcacctgtaatcccagctacttggaaggctgaggcagggagaattgcttgaactgggaggtggaggttgcagtgagctgagattgcaccactgcactccagcctgggcgacagagggagactctgtctcaaaaataagtaactaaagtgtacaattcagtggttttagtatattctcatattcttaaatctcttagtctatagcatttccctcactcccctcctttccccatacacttacccattgaagaaactctcattttgttccgtagcattttctgcactggcagatttggccaactcatcatgatggcatcgttcagcattcctctgtcccccatgtttcctgtgagccgggagctaggtctagagccttaattagatccaggtccagattatttatttatttattttttgtatttataataaataatctagacaggtccagattttttggcaagaataatttatagtgctttatatatttcctatatttatatcacaaatcatatgatattataaaatagtgatgctgagattaattagtgggttcacataatggttttataaccagtgattgtggttgcctggctccattatgtcattagtgggttgcagaatagagataccctaattttgtcttttcttttttttttttttacatttattagctatgatttttttttttttcagaatagctatcctagcaatctctataagtgaccagtgatttttttttttttagtatcattttgaactcagggttttttatatatttgtatttcattccattatagtcatgctttttgctgccaaattcatcccatctttggatagtaggagtcccttcaaattggctcctgtgcctcttttacaagaattttaggtttttgatcacttttgcttccaggcataggatgtcccaggttcaatttgtaattttcttgcttaaaacctggaatctggccaggcacagtggctcatgcctgtaatcccaacactttaggaggctgaggtgggcggatcacttgaggtcaggagtttgagaccagcctgacccacatggcgaaactccgtctctactgaaaattcaaaaattagctgggtgtggtggcacgcgcctgtaatcccagctacttgggaggctgaggcaggagaatcgcttgaagccaggaggtggaggttgcagtgagccaagattgcactgcactccagcctgggtgacaagagtgtgacaagagtgaaactccgtctcaaaaaaaaaaaaaaaaaaccctggaattagttacttctccaagaagctctgatttctttagtggggaaagtgaattgtggagtgcttattgctatcatgttgccattgtttctaggtctttttagtggaaatagctaggaaataggcatttttttaggagacaaaaatagtaagtttatcctgataatttccagtttaaataaaaaatggtacaatatttttacttaattttcgattttgtatttctatctttttgtatcccccaaaaagatacatttgtacccaaaaaggtacattgtacccaaaaagatacattagtgacattaaaattcttatttgcagctggtctgatggtagtgggttatcaggacttattaacattagtgtcactgaagttggtatacaaccccccacgctaagtttgactggctttaaaaataataataaataggtcgggcacggtggctcacgcctgtaatcccagcagttttggaggccgaggtgggcggatcacaaggtcaggagatcaagaccatcctggctaacacagtgaaaccccgtctctattaaaaaatacaaaaaattagccgggtgtggtggcgggtgcctgtagttctggctactcaggagactgaggcagaagaatggtgtgaacccaggaggcggagcttgcagtgagccaagatcgggccactgtaatccagcctgggcgacagagcgatactccgtttcaaaaataataataataataaataatttaaaaattaaaattagagaaaagaaagaaaaatatttttcaaaaattttattatttgctttctcctacagaatgtactttgtagtagtgacattaaaagacattaaaattatttgctatacagtgatattaaaattgtttgctgtagtaacattaaaattgtagtgacattaaaactattatttgctttatcctacggaatgtacttaatagtatcaaaataacaatgctcttgttattgccaataacactatttctttttgcttctttatataatttttttcttaatgcttttaaaatttttttatactttatttttattttttagttttttaatagagatgaggtcttgctatgttgcccagcctggtcttaaactcctgctctcgagtgatcctcttgcctcagctttccaaagctaagaatttttttgaagagcataatttgaccctcagtttctaagaagtaggaatggtaatgggatgcatagcctgccatgtggctgttggatggaccagaaaaccttatactctagggcctataggaatatcaagtatttttattgatttcccctggtatgtaagcagcagcttatgggatcagtgtgatggttaaggaaaattactcaaagcccatgttcagggccaggtgcagtggctcatactaataatcctaacactttgggagcctgaggcgggaggattgcttgagcccaagagttcaagaacagcctgggcaactttgtgagacttcatgtctacaaaaaataaaaatacattagtctagtgtaggggctcacacgagtgataagtagtgaagctaggatttgaacccagggttcaatctccagattccaagcctttgtgtctggctccagattccaagcctttcatcactacactgtgctgctgcttataggagatagtctcactctgttgcccaggctagagttcagtggcacaatctcagctcactgcaacctctgtctcccaggttcaagcgtttcttgtgcctcagcctcctgagtagctgagattgcaggcgtgagccaccgcgcccagccttaaactgaaaattatccactacatggtagaagcaccatataatgtaatggtttctacagtctttaattatgataatacagatatctcaaagtaagttcttaccttgtatagactcagccaatttttttaaaaccacacaatcctatttatactttcaaagcctttttcttaccattaatattaaaaaggaattggactctctttagtgtgtgtacatctggaatgaaagtcttcatcaaattaaatggagcccctttgatattagataacagtgccgacatgagcagggttcaccttagttcagaattaccagctctgtctgggagaactggaatacatattaatagtaacttacctgccaggagtttatgtcactcttaaaatcctgtagcctatagaggagattcctgtcagtccggttttcacatgctgatagaattaattgagtttaacattataaatactgtcctcttctcttttaacagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaaggtaaaacaatttgcttctgacctaacatgttaaataattagaaatgggagaagaactgttggtgtaggatttcttaaaacttgtgtggacttgaagagaagaagtcatatcaagttgctttattgagtcatattattagaatataccctttggcttgatctaactatgtgtattaattaggtaagtatttgaaaagttgagccacattttacaatttaacgttattccagaggtacttttttaaaaaaataaatctgtctttagtgaaagggcaaattcagaatttttaaagatgccttctgcctttgctgttgcatccaatgtatgcatgttacattctcctgctgatgaatgaacaatccacaccattttccttgcacaccaggcaacatgcattctgaaaaatacaacacagttaattaattctaataccactccataaattttaagcagcaaccctggtagtgccaatatactagcaattccctcagcatatttgctcttaccacttagcacagttgctcacaaactgcactgttaggagtacagcgtcactagtaattaaaaggacagtcatagtaacattacactttggtgtgctaataattgctgaagtgtgagactagtggataataaactcattattataaagtacctcttaacctgctaagaactttacaatgatgactgatgtttttaagaatctatttttgaaaaatgatacttgcaaagcttttttttttttctttttttttctgagatggagtctcagtcacccaggctggagtacagtagtgcagtagtgtgatctcggctcactgcaacctccgcctctgggttcaagcaattcttctgcctcagcctcccgagtagctgggattacaggtgcccactaccacacctggctaatttttgtatttttaatagagatggggtttcgccatgttggccaagctggtcttgaactcctgggctcaagcgatctacctacttcagcatcccagagtgctgggattacaggcatgagccactgcacccggcaacagttatttcttagtgtgtctaattcctggtccatattcataattttacagttgcctcaaaattatctgtttacagagagcttgtttacactgctgaagtccacatgttatgtttcctgtggggtcttctctttctctcttaatcttgaacagttcctccccggcaccacgtggttattctcacctcctggatcagttgtccaatatagtgtccaaaaccttctggatttgtctgattgctaccttgtggtggtaaatttgtttttttatccttgtatttcctacaaactgacagttagatctacagactagattcgattcagatcagtcctattttacgttttttagagatgaggtcttgctccattgccgaggctggtcttgaactcctgggctcgagcgaccctcccgccttagcctcacaaagttctgaacttacaggtgtgagccacttgcaactggcctaaagtgtttttcttatgcttttaaaagcagattttttgttgttgtcgttgttgttacagataatatttctatgcatcttgacatcatggagaaatcctttttgagagaggtagaggggaaaatttagtgatttccaaaatcatacatcatttatggattttaattcactttatttatgaatataaactataatatgtttaatttatcttgcttatacttggtatgtttataagtatttaagtctaatctcttgaagttttaatttttccctggcatttgtatataaaatagtatgcatgagttattgccacattcaaagttggtacttgttttggagactggtgttagtcatactaaatgtgttttgttgtttccagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaaggtttgtagccatttaacttataaatacataagtctgaacattctgtggggacaagggtgtgtgtagttaccgctgtgcaactcagaagcatgtgcatgacgaatccccatatgtagcacagcatccccagtactttgtaaaatgttcgttgactgagtcatagctcaacagtgtgactactgaatcattgaaactgaagctaaaatggtatctgacaagttcttctttttttaagtttagtaattttgacaatgcttcatatatgtcagtattatactctgtattttgcaaagcactttcatacacattttgcatttatttaattttacttttttttgtttttttgagacagaatctcactctgtcgcccatgctggagtgcagtggtgcgatcttggctcactgcgacctccccttccccagttcaagtgattcttgtgcctcagcctcccaagtagctgggattacaggtgtccaccacatcacccaaataatttttgtatttttagtagaaacggggattcgccttgtcatccaggctggtctcgaactcccaacctcaggtgatctgcccaccttggcctcccaaagtgctgggattacaggtgtgagccactgtgcccagccatattgttcttaaaggttacagtcctttaaatttctggataaagagcttgcaagataagaaaaaaatatcccctatttccctgcagcttcaaggaaagcagatatattaatagttagagtcatcaaactctgcagaagcaggtgcttaaaaaaggttaaacagtgaactgggaaaataacccctgacttctgaaaggtctttgttctgattgattttcctactcagtatgtattgctgtggtaataacatttgtttttcttttatcaaaggtataaagctctaatgagatttcttcctagccagaggctagcctgtagttatttatgtgaaactcttttttttgctaaatgaagccacaatttgtgttaaaggctattcagtgtatatttagctgcaaaatgcatttatgtacaatcaagaacttctcttgagcagtgtttctcaaaagtgccctccttgtatcagcagcatcagcccttgcctgataacttattcaaaatgcaggtcctcggccccaactcctgacctactgagtcatagactctgtggatgggcccaccagtctatttttcaacaagccttccagatgataccgttgcacactaaaacctgagagccactgctctagactagaggtgagatcaaactcagattccatacaattgatataaaaaaccacaggccaggcgcagtggctcacacctgtaatcccagcactttgggagccccaggtgggaggatcactcgagtccaggatttcaagaccagcctgggaaacatagcaagaacttgtctctacaaaaaaatttttttaagttagccattaagtggtggctcatgcctgtcatcccagctactcaggaagctgagcaggaggatcgtgtgagtgcaggagttggaggctacagtgagctcagtggattgcagcactgcactccagcctaggcgatgaagcaagacccatctctattaaaaacaaaaaacaagcaaacaaacaaaaccagcgctgggcatggtggctcacaccagtaatcccagcactatggaaggccaaggtggtaggatcacttgagcccacgagttcaagaccagcctgggcaacatagtgagaccccacctctactaaaaatttaaaaaaattactccagcatggtagtgcgctgcttgtagtcctagctactgtggtggcagaggcaggaggatcacttgcgtccgggaggtcgaggctgcagtgacccatgactgcagcacggctctctggcctgggcgacagagagagaccctgttccaaaaacaaaaaaaccacaacactacagactaacctctggctaacaaaggaattttttttttaaggtggggtctcactgtgttgcccaggctagtcttgaactcctggactcaagcaaacctcctgcctcggcctcccaaactgctgggattacaggcatgagtatgcacccagcctaacaaaggaatttcattaaggctttatacctttgagagaagaaaaacaattaagtattattaccatagcaatgcatactaactaggaaaatcaatctgaacagcagacctttcagaggttaggggttattttcccaattcatggtttacataattcctttctatagtttatataactcctaccacctgccattcagtcacctttgtaactatcatttttaataatgcacattctcagtttattctttacttaccgagttccatttaccttggaagtaaaaacattttttccaaattcttacagctatctgcttcagcaaatggttaaatacaccctaaattaaatactttatttaaatgaattaatcatatctaccaagtcatatatgattttttgttttttgtttgcagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtattacagtgctgcgatcttggcttactgcaacctctgccattccaggttcaagcgattctcatgcctcagcctcctgagtagctggaattacaggcacccaccaccacaccttgtttttgtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttctatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatgagatgatactattcgtggatatttgtttgctaatgcatattgcttggaatatatgtgagacattaaaaaaatgacagcacgactttgcagcattacctctcagtgtcttcgaagtactaggtgacagctggggctcgagggagtttccctgtgcatcattgtctcggctgggcctctgaaccggcttcattgtccatccgtttgcctgatgagaagggaaatttgaaaatttctgtacagttgatctcagttgccctgacaaaaggcccaatccccagtacaggacttaattttaattcactgcttccacagcagcacaaaatgagctagtagtgttagatttcatctgcactgtgatgtattttacagttttcacctatatgatatagactgttgggaaaccaagattgtttcccagccctaagagttcctagcccatggcaccaagtaaaataacccaaattgtgtatatggtgggaaaacagaaatgtataccatatacaacacctcgctttattatggtccttgctcatgaattttaaggtatatatgtatgtttagtgatcatttcagctaaatgattggcccaagcatgtctccttggagaacgactcttccaaaaaagaaagtattagagttctctctgcctcaattatttataaaatataattattttcaaggagaaaaaagttcctcattctgtttattcttccccacagtttctgacctataaacaatatccaggatatttagcacaggacctagtatatagtcgactcttcataaatatttgttgagtaaataaatgctggtgattttctcgttgttttgtgtgtgattttctgttttactaagcaagctctaaagcagctgttgaatgcagaatcatccttaaacacggtagaagatgagatgacactgaagatgtgccatcctaaaaatctcttagattctgaggcatggataattgggtctggatttctcccattcaactttaccactctaacgacacaaaagaagggaaaacaactcataaatacagcatacagttttaactatttacataataactcaatagagcatgcaagtattattcatggcacaggataatggagagctttttctgtatgaccataggggaaaaaaagtctgctttaaaatatacttatttgaaaatcacccagaatagcccgttagaaatacacactggaggccaagcattttgggaggtcgaggtgggcagatcacttaaggtgaggaatttgagaccagcctggccaacatagtgaaatcccatctctacaaaaatacaaaaactagctgggtgtggtagcatgcacctgcaatcccagctacttgggaggctgaggcaggagaaactcaaacctgggaggtggaggttgcagtgagccaagattccaccactgcactccagcctgggcaacagagcaagactccacctcaaaaaaaaaataattagccgggtgtgatggcccatacctgtaatcccagctactcaggaggctgaggcatgagaatcacttggatccaggaggtgaaggttgcaataagccaagattgcaccagtgcactttagcctgggcaacagagtgagctctgttaaaaaaaagaaagaaatatacactgttcaggcatagtggctcacacctgtaatcccagcacttcgggagtccaagacgggtgaatcacttgagctctggagtttgagaccagcctgggcaacatagggaagctttgtctctgctaaacataaaaaaaattagctgagcttggtggcgcacacctgtagtttcagctacttgggaggctaaggcaggaggatggcttgagcctaggagatggaggctgtagtgaatcatgattccatcctaagcaacagtgcaaaacctttcttaaaaaaaaaaaaaaaggttgggggctgggcgcagtagctcacacttgtaatcccagcactttagaaggccaagatgggcagatcactagagcccaggagttcgagaccagcctggccaacatggcaaaaccctgtctctactaaaaatacaaaaattagccggatgtggtggcatgcccctgtagtcccagctactgggaagctgaggcaggacaatcgcttgaacatgggaggcggaagttgcagtgaactcagatcacgccactgcactccagtctgggcggtaagactctgtctcaaaaaaaaaggggagctggccgggcgtgaaggctcacacctgtaatcccaggactttgggagggcgaggtgggtggatcatgaggtcaggagatcaagaccatcctgactaacacagtgaaaccctgtctctactaaaaatacaaaaaaaaaaaaaaaaaaaaaattagccaggtgtggtggcaggcacctgtagtcccagctacttgggaggctgaggcaggagaatggcatgagcctggggggcggagcttgcagtgagccgagactgtgccactgcactccagcctgggcgacagagcgagactccgtctcaaaaaaaaaaaggtggggagctgacctgggtgtgtttggctgtgcatatgcgtcatgcaacctgattttaaacttactgtgtataaagctaaagcaatcaaatcatatggttttagcataagtaaagacatacagatcaatggaacaaaattgagtccagaaatagacccataattatatgatcaattgattttccactaaggtgccaagttaacttgatggagaaacaatagtcttttcagtaaatggtgctagaataacgagtatctatatggaaaaagacatactcaagagtcaaagtttgataaattattatttattttttactaattcatcaactacagtcttgggtgcagcttgctttgtttttcctctaagtgcgtgattggggagaatgcagtgataattagtagtttggtgcccatgccctgattcatactagacaccagcagtttcatcccatcactttagtgtccacagccccagtgtgccaccacagcaaaaaaagccaagtcgcatttagtattgtgaaaacagtattgacctcatgacccccccccccgaaaaggatctgtggaacacactttgagaactactggtctagaaagagctagaaagagaaaataaggaggattgagacgaagttgtgaagaaatctagtaagtgctggcctggttggagaatgaacctgaaaagaaacacagaaggagtcccctgagatgtagaaggaaccagaaggctgagtgcagtggctcacaccagtacccctagcactttgggaggcctaggtaggaggaccacttgaagccaggagtttgagaccagcctgggcaacaaagcaagaccccgcctctacattttatacattttattgattgattgattagacagagtttctctcttgttccccaggctggagtacaatggcatgatctcagctcactgcaacctccgcctcccaggttcaagcgattctcctgcctcagccccctgagtagctgggactataggcatgtgccaccatgcctggctcatttttgtatttttagtggagatggggtttcaccatgtttgccaggctggtctcgaactcccgacctcaagtgatccacctgcctctgcttcccaaggtgctgggattacaggtgtcccacagccacagatcctggcctcattttatacattctaaaagaaaaaaaaaaaaaacagaagagtgcagtcaagaagtaagggagtggccaggcacagtggctcatgcctgtaattccagcactttgggaggccagggccggtgatcacttgaggctagaagttcaagaccagcctggccaacatggtgaaaccccgtctttaccaaaaatacaaaaaattagcctggtgtggtggcgcacgtctgcagtcccagctacttgggaggctgaggcacgaaaattgcttgaacatgggaggcagaggttgcagtgagctgagattgtgccattgcactccagcctgggcaacagagtgagaccctgtcttaagaaaaaaaaatttaaaaagaagtaagggagcggcttcagaaggaagaaggggccatgagcatggatgcagttgagagatgcaaggagggatgagggatgtctcttggtttcgaggcatggatatcactggggatcttagcaggggatgtttccatggtgagcaggtcagaagtcaggttggagggagttgggggagtgtgagatgggaggaaatggagccggtgaagtcaaagcagtcttcagaggaacgtatgaaggagaaaacaaagagacagccacagctgaaggaaggagtcacaattgctaatgtcctcctcctgcataaatggatgaactggtgatgcagaggatttggaagagggagcaaaggaaaatgctaagatgacgcttgggtttcccacttagggaatggactgaatagtggtctattgagatggaaaacaaggcctaaggtaggtagaacacacctgtagtttgaggtgagaaagcattttcctacgaaatcttaatttcctttttaaggaagtttttgggttctttactcccaaacctcaaagcctgcctactgcttctgttggtttacacacacacgtacacaatcaagagcttcaaaatcttacatggtcttgttctgttgcccaggctagagtgcagtggcatgaacatggaccactgcagcctcaacctcctggactcaggcaatcctccaacatcagcctcccaagtagccgggaccacaggcacatgccaccatgcccagatcatttttttttttaatttttgtagagacggggtcttgctatgttgcccaggctggtctcaaactctggggctcaagtgatccgcccacctccacctcccaaagtgctgggagtacggacatgagccactgtgtctaacaaggtcttaattttaatgcactttttatcttttttttttttttttttttgagatggagtctcactctgtcacccaggttggagtgccatggcgtgatctcagctcactacaccctcctcctctggggttcaagtgagtctcctgcctcagcctccagagcagctgggaatacaggcacgcaccactgcacctggctaatttttgtattttttagtagagacggggtttcaccatgttggccaggctggtcttgaactcctgacctcaagtgatccacctgcctcagcctcccaaagtgctgggattacaggcgtgagccaccacacctggcctaaaggtctttttatcttgtcccttttgtgaattaaaagtacatattaatttatctaagaacaaaaaaagttacgtcttcatatcatggaagattctcaatttttgctcatcagagaaatgtatatctttaattgggactattttggtccacttaattgagcattttcttcttttagtgaacagaattaacttgagtcattttattctatgcagtgagaaattataaacaagtggttttgagagtttgcttaaatgtatttttatccctcctgctcttatataggagtcctaattatgagaacacagttgccctaaaatttttacattttcagcaatgtatgcttgcccatgaaaagaacacattctttttgaataaagaatctactatcttcaatttcttccatttagtaagagcaaaaccagggccaggtgcagtggtcacgcctataatcccagcactttgggaggctgaggcagacgggttccttgagctcaggagtttgagaccagcctgggcaacatagcgagtcctcatttcaaaaaaaaaaagagagtgaaaccaggaaaaacacttttctactctcatttgtgggaaccaatatcgcgagtttatttaacataaagataattagttattcaagtaaaataagaagaagtttttttttattttgttttgagatggaatttcgctcttgttgctcaggctggtgtgcaatggcacaatctcggcttactgcaacctctgcttcccaggttcaagtgattctcgtgcctcaaactcccaagtagctgggattacaggtgcccgctaccactcctggctaatttttgtatttttactagagacagggtttcaccatcttggccaggctggtctcgaactcctgacctcaggtgatctgcccacctcagcctcccaaagtgctgagattacaggtgtaagccaccgcacctggcctgaaatgaagatatttttgaatgaatgttcttgcattaaaggaataatggccaggcgtggtggcttgcacctgtgattccagctgctcaggaggccacggcaggaggattgcatgagcctgggagtttgaggctgcggtgaaaatacatagataaataaaggaataatggatttgcttttaggcccatcagattttaaattacatatagtggaacaggtacagaacatggagctgaagtgattttcacaaagctgtttcaaataatcaccttcattttttttcattttttaaaagaattttaaataaaaaagaaatagagacagggtctccctttgttgtccaggctggtctcaaactcctgggctcaggcaatccacctgcctcagcctcccaaagtgctgggattacagcgatgagccaccatgtctagcctccttttttctttcaaagatgaatgtacaaaaacggaaattaagtttaaaatcattagagtctttaaaacattacacactgcaatgaaatagacaactgcatattgcacactttcatgaaaatttgcacataaatttaaagcatttcacaatttgacaaaatattctcataaactaccaaaaaagccttaaagctatatgaaagatatggaaatgttcacttttgatctgtcactttcaccttaaataataaggtaaaataagttctgaaaatttcagatgacattttccattgctgtattgaaagaagatatacttcctattttcttaaagttgtgtttaataaaacaggtaatacccatgcatgataaacagttaaaacaatattagaagagaattctttttttgtttgtttgtttgagacagagtctcgctcttgttgcccaggctggagtgcaatggcgcgaactcagctcactgcaacctcagcctcctgggttcaagcgattctcctgcctcagcctcccaagtagctcggattacaggcacctgccaccatgcccagctaattttttgtatttttagtagagatgggatttcaccatgttgctcaggctggtctcaaactcctgatgccaggtgatccacccacctcagcctcccaaagtgctgggattacaggcatgagccaccacgcccggcctagaagataattcttgaaaagtattttgggttgggcatggtggcttacatctgtaatcccaggactttggaaggccaaggtgggaggatagcttgagactagaagtttgaggccacctggccaacacagcaagaccctatttctatttttttttttttaaagaaaagttttgttttgttttgttgagacagggtctggctctgtcacctaggctggagtgcagtggtgtgatcttggctcactgtaacctctggcttaaactaacctcccacctcagcctcccaagttgctggaaccacaggcacgtgccaccatgcccggctaatttttgtacttttttgtagagacaaggtctcactatgttgcccaggctggtctcaaactcctgagctcaagcaatccacctgcctcagcctcccaaagtgctgggattacaggcacgagccactgcacccggcctagatttcttctctttacatttggaaagaaaaataagaaccagaaacctgagtatccctcttgcattctggattttctccttgctttaaagagggctttagaaagaatgggtcactgggtatctggaggccacacgtgattccgtgctcaccacgctggttccctgcaggtgctggaaggtgagaaagtccctgtcccttcctgccttccaagactcactgacaagaatgagaagcctgagaaatctctgtggtatgtgggatgacaccgcccaatgaattctgaaagaaacaggagaaaagaggcactaaagcctatgtagaagcttgaggaagagaatgtggcctgtgcagttggagtcccgccttcctgccctcatcctgacattctggtgacaccagcctgacttccagctgccacccactgtatttccctgcctgaggacttccttgagcccccaggtcctcctttgccacagaatgacaggtcagaagtgcagggagtggactaacctgccccaatccctccatggatgactgacaggtggaggtgcacaaaggtcccacactcctgccccttaggcaggaggatcagatgcgcattctacattggctcccagagttctctagcagattaggttttagaggctcccaggggaccctgctggaaaacacacccactgttgctcccatcccttccctactggaattcccctctgcccactgtgtttcttgggattacctacctcccacacgactggttgcacttgaaaccttgggagaactcaaggcaacgcaagacatatttgagttatatagatagacagatagagggagagagtgtgtgttttgttctgttttttgtttttgtttgtttgtttgttttgttttgttttgtttttagtgctgaagtctccctctcacccaggctggagtgcagtggtgcaatcatagctcactgcagcctcaaaaactcccaggctcaagagaacctcctgcctcagcctccaagtagatgggactatgggtgcccacagccactcctggcaatgttttaaaattttttaattttaattttttttttttttgagacagagtcttgctctgtcaccaggctggagtgcagtggcacaatcttggctcactgcaaccttccccttctgggtccaagcaattctcctgcctcagcctcctgagtagctgggactacaggcatgtgccaccattcccagctaatttttgtatttttagtagagatggggtttcaccatgttggccaggctggtcttgaactcctagcctgaaatgatccacccactttggcctcccaaagtgctgaaattacaggcataagccacgatgcccagcttttaagttatattcaagttgttctttgaagtaggggaaatgtctttctgtgtgtgtctaagatatgcaagttcataaatttacattctgtgtgtgtaagagttctattcattagtcacacctgtggagtagtgcttgtcaatgtgtagggcaattatattagatttcttgccttaggatagaagataattctcctggccaggtgcagtggctcacacctgtaatcccaacactttgggaggctgagacaggcagatcacctgaggttagaagtttgagaccagcctggccaacagggtgaaaccccatctctactaaaaatacaaaaattagccaggtgtggagtgcgcacctgtaatcccagcttctagggaggctgaggcagaagaattgcttgaacctggaaggtggaggttgcagtgagctgagatcccaccactgcactccagcctgggtaacggagtgagacttcatctcaaaaaaaaaaaaaaaaaattagccgagcatgatggcatgtacctgccgtcccagctactcaggaggctgaggcatgagaatcgcttgaacccagtacgtggaggttgcagtgagccaagatcacatcactgcactctagcctgggcaacaacaagagagcaagactctgtcttaaaaaaaaaaaatctagactctgtctaaagaaagaaaaatctagactctaaaatatatatatgtgtatatatatgtatatatgtatgtgtgtgtgtgtatatatatacatatatgtgtgtgtatatatatacacatatatatatataaaaaaacaaaactatagtaaccaaagcagcatggtactgacatataaaaatagacacatagaccaatggaacagattagagaacccagaaattaatccacttatctacagccaactgatttttggcaaaggtaccaagaatactcactggggaaagaacagtctcttcaatcagtcgtgctaagaaaactgaagatccacatgcagaagaatgaaactagaccctcacctcttattctatacaaaaattaactcaaaatggatcaaagaactaaatgtaagactggaacctataaaactaccagaagaaaatatatagacaggaaatgcttcaggacattgtctgtgaaaagattttatgaataagacctcaaaagcacaggcagcaggagactgaggctgcagcgagccttttgtactactgcactccagcctgggcaacacagcaagaccctgtcaaaaaaaaaaaaaaaaaaaagcataggcagcaaaaataagtaaatgggattatatcaaactcaaaagcctctgaacagcaaaggaaacaatcaacagagtgaagagacaaccaacagattgggagaaaatatttgcaaactactcatccagtaggggatgaatatctagaatatacaagaaacccaaacatctcaacagcaaaaaaaaaaaaaaaaaaaaaaaatttccaatctaaaaaatggacaaacgagggccaggcacggtggctcacacctgtaatcccagcactttgggaggttgaggcaggcagatcacctgaggtcgggagttcacaaccagcctgtccaacatggtaaaaccctgtctctactaaaaaatacgagtagcctggtgtggtggtgggtgcctgtcgtcccagctacttgggaagctgaggcagaagaatcgcttgaccctggaagatggagattgcagtgagctgagattgcgccattgcactccagcccgggtgacaagagcaaaactccatctcgaaagaaaaaaaaaaaaaaggacaaatgatctcaaaagaagacattcaaatggccaacaaatataggagaaaaatattcaaaatcattaatcgtcagggaaatgcaaatcaaaaccgtaatgaggcatcatttcaccccagctaggatggctattaccaaaaagacaaaaaaataataaatgctggtgaggatctggagaaaagcgaactcatgcagtgttagtaggaatgcaaaccagtactgccactaaggagaatagttgggaggttcctgaaagaactaaaaatacaactaccatatgatccagccatcccactactggatatttattaaaaggaaaggaaatcagtatatcaaaaagatatcttggctgggcactgttgctcatgcctgtaatcccaccactttgggaggccgaggccagcggatcacctgaggtcaggagttcgagaccagcctggccaacatggtgaaatcccatctctactaaaaatacaaaaataagccaggcgtggtggtgtgcacctgtactctcggctactcagaaggctgaggcaggagaatcacttgaagccaggaagcagaggttgcagtgagccgagatcgcgccattgtactccagcctgggaaacaagagtgaaactccatctcaaaaaaaaaaaaaagacatctcacccccttgtttattgcagcactattctcaatagccaggatatagaatcaaccaagatatggtatcaactttatccggtcatccggaaacaatagatgaatggataaaaagaatgtgatatatttacacaatggaatattattcagccatgttgtcatttgtggaaacagggatcaaactggaggacattattttaagtgaaataagcagggaacagaaagttaaataaacactgcatgttcacattcttttttttttcttcttttttttttttttcttgagacagagtctcactttgttgcccagactggagtgcagtggtgcaatctcggctcactgcaacctccacctctcagattcaagcgattctcgtgtctcagcctctcaagtagctgggactacaggtgcgtgccaccatacctggctaatttttttttcttttttgtatttttatatagacagagtttcaccatgttggtcaggctggtctcaaacttctgacctcaaatgacccacccaccttggcctcccaaagtgctgtggttataggtgtgagccgctgcgcccggcctgcatgttccatattcatatgtggaagctaaaaaaaagttgatctcataaaagtaaaaagtaaaacagaggatactaggagctagggagggtagggagaatggagggatagggagacatttgtcaaggatacaaaatttcagctacataagaggaataatttctcatgttctacacctgtataggatgactacagttaacaataatatattctatagtttcaaatagctagaaggagggccaggcgcagtggttcatgcctgtaatcccaagcactttgggaggccaaggcaggagaattgcttgaaccaaggaggcggaggttgcaatgagccgagatgcactattgcactccagcctgggtgacaaagtgagactctgtctcaaaaaaaatagaaaaagaaaaagaaatagtgaaggggccaggcgctgtagctcatgcctgtaatcccagcacattgggaagctgaggtgggacgattgcttgagatcaggactttgagaccagcctgggcaatatagtgagaccttgtctctataacaaaatcaagaaaattagccaggcatggtggcatgtacctgtagtctcagctacttggagaatgaggtgaaagaatcgcttgagcctgggaggtcaaggctgcagtgagctgatttcatgccaccgcactccagcctggctgacagagcgaaattctttctctccaaaaaacaaacaaacaaacaaaaaaaggagtgatgggagggatgtgtgatttttgttctttgaaatgtgttgagataggggctgggtgtggtggctcacatctgtaaccccaccactttgggaggccaaggtaggtggaccacctgagcccaggagtacaagacccacctgggcaacatggtgaaacaaaaaaataaccaaagaaattaaccaggtgtggtggcgtgtgcctgtattctcagttacccgggaggctgaggagggagaattgctttaggccaggaggcagaggctgcagtgagccaaaatcacaccactgcactccaacctgggtgacagaaagagacccatctaagaaagaaagaaagatagaaaggaaggaaggaaggaaggaaggaaggaaggaaatatgttgagaaagaaagaaaaagaaagaaagaaagaaagaaagaaagaaagaaagaaagaaagaaaaagaaagaaagaaaaagaaagaaagaaaaaggaaagggaaggaaggaaggaaagaaggaaggaaatatgttgagatagatccttcctgatcattcttctttcctccttctcatcacttgggaatctgaggatgtggcaccaggattctctgctccaggaacaccaatttccccacttgagttacccatcctttgtgtctcttctccaggagctcgcactccaaccaattaagaaaagatttggctacaatgacacattggctggaagacacacccacaaacccatggaccaccggactgtgagtaacagtccttacttatgcctccttgcaccccagtgttaaatattggtagaatgaataaatgaatgaatgaatgaaaggcaaagacagctatttagtcaagtacccagatatttcttgaaaaggatgttattgtggccaagaggctgtgtgccaccttatttatttatgtatgtcacccagactggaatgcagtggtgcaataatagctcactgcagcctctaactcctggcctcaagtgatccttccagcttgacctcccaaagctctgggattaccaggtgtgagctttgcctggcctaagcataacttttgatcttcataggatccaaagtcatgaacttgtagccacgttgacaacttgtccggcttgaacagattgaataatcaagcagacgtagccatagtgtcacctgtgagaaactgcaatattttatagctgctttgtttgtttttttgagatggagtttcactatgttgcccagggtggtcttgaacttcctggactcaagcaatcctctcgcctcagcctcctgagtggctggaactatagggactcaccactgtgctaggcaaaattgtaatgtcttacagacacatacacacacacaaaaaaaactaattatgatttaaaaagctagacagagataatatcttataactcaaggtttttcagccatcaacacatagatgttgattaatcattcaacattaattatggttgtgtttttcaggtcctgttttagaactttgaacaggtcaataatcttgtattgctgtggtcacagtcccttgctaattactgaaggtaaataagatgtgatcacaagaaacagtccactcactgtgtctcacatattctctatagccctaagagaaatgacttccattatattttaagttggttatattggctagtttctttcttttttctttttttttttggagatggagtcttgctctgtcgcccaggctggagtgcagtagcacgatcttggctcactgcaacctcctcctcccaggttcaagcaattctccagcctcagcctcctgagtagctgagattataggtgcccaccaccacacctggctaacttttgtatttttagtagagacagggtttcaccatgttgtccaggctggtctcgttctcctgacctcaagtgatccatctgccttggcctcccaaagtgctggggttacaggtgtgagtcatcgcacccagctatattggctagtttcaaaacagatcaggggctatccatttgaaaccgtcccactaacatgatatgacaaggtttgtaagtgataagcttggcagcttcgatttctggcacaaggtgtgtggcctcccagagctctagcctgtcctctctgactcagtttttcttgctctgtaatgggttctgtccatttgtcagcctgcagattttcagctggatttttttttcatgtcagccaaataaatacagaaattgctccccccaccctgattataatcattttggccacatttttcaaagcttactcttagaccatcccaaaactccagggtaactccatattattattcaaattttttctcaaattaaatgtctgttaggctggttacacaatcacaataagggaaaagcttggccctttcattttgcattttacctcagagaaggtccttgtggcttgactttgcacattactggaaacagaatttgcctttctgctcctttgtgaggtagtcaaagcacgatgtgcatgtggttccaaacacatttaattctgtagctattcttttgttgaaggcgctcaccacaaaacatcctggagggggattacggggcaggtgcaacagacaagggtgtttcccggatggggaaggcagagcgccaagtaaaggagtaagtgctgaagaagggattttacttgaaattggaagtcataggagctatttggttttgggggtgcatgtttaagtgatacatttatagattaaaaacgaaattcaggccatgtgctgtggctcacacctgtaatccagtacctgcagagcccctcctgccttggcctcccccagaaaaacaaagaatttcagagtcaatagcacgttatgttttgactacatcacaaagaagcagaaaagggccaggcaccgtgtctcacgcctgtagtcccagcactttaggaggctgaggcaggccgatcttttgcgttcaggagctcaagaccagcctggccaacgtggtgaaacctcgtctctactgaaaatacaaaaaaattaatcgggcatggtggcatgcacctgtagtcccagatacttaggatgctgagacaggaggatagttcgaacccaagagacagaggttgcagtgggttgaggttgtgccactgtactccagcctgggtgacagagtgagtctccatctcaaaaaaaacccccaaaacaaacaaatgacaacaacaaaagcagcagaaaggtaaattcttattttcctcttttaaaaaaatttcctttgttttaggaattctttttccagacatgtgtcaagccaagccatgagggccttttccaaggtaaaatgcaaaacaagcgggccaagcttttcccttatttttccctccttgcctaggagtttgagaccagcctgggcaacagagcaagacctcgtccctacaaaaaaatgaaaaaaaagaaaacaaaaacaaaaacaagtggctgggtgcagtggctcatgcctgtaatcccagcactttgggaagccgaggtgggcagatcacgaggtcaggagatcgagaccatcctggctaacacggtgaaaccccatctctactaaaaatacaaaaacaattagccaggcatggtggcaggcgcctgtagtcccagctacttgggaggctgaggcaggagaatggcgtgaacccaggaggtggagcttgcagtgagccgagatggtgccactgcactccagcctgggcgaaagagcgagactccgtctcaaaaaaacaacaaaaaaaagtagctggatgtggtggtgcttgcctgtagtcccagctactcaagaggctgaggtgggaggattgcctgggtccaggaattggaggctgctgtgagccatgatcacaccattgcagatccagcctgggtgacagagcgagaccctgtctcaaataaataaataaataaataacagttcagaagagtataaagtgaaagtctcaatttttcatggatttcttatgctctagttttcctcccctggtcttctgttacttccatgtatacccttctagagatagacgatgtgtatgcacatagacagggcactcttatgactggtaacatattataacattggcccactttgtttgctattttgcttttctgtaacaatatactcattcaacaaatatttattaagtacctaatgtatgcttgaatcctgtcctatgtactcaggatagagcaatgaacaaaccaatcaatattagttttctattgctgtgtaacaaattgttgcaaatgcagcagtttaaagaaacacatttagtctctctcagtttttgtgggtctagagtccatgcactgtttccttgagttatctgtttcaggttcttgccaggctgcaatcaagctatcaacagtgctgtgttctcatctggagactcaactggagaagaatttgcttctaagcccactccagtggttagtggacttcattttcttgtaggaataggatggagagctttggatttttaccagctgttggccagaggtcctcagttcctggaggctgcccctgtgcagttgacaagcagcagcttgcttcaggccaggccagcagaagaaagcatatctgctagcaagacggaagtcttattggctgggcgcagtggctcatgcctgtaatcccagcactttggggggctgaggcgggtgaatcacccgaggtcaggagttcaagaccagcctagccaacctgccgaaaccccatctctactaaaaatggaaaaattagccaggcgtggtggtgggtgcctataatcccagctactcaagaggctgaggcaggagaatcgcttaagccctggaggcagaggttgcagtaagttcacactacagcctgggtgacacagcaagacacacacacaaaaaagcaattatttttgtgtagctctgtgtaacctcgaatttttgggctcaagcaatcctcctgcctcagcctcctgagtagctgggactaaaggcatgcaccaccatgcccagctaattttttttttttttttagacagagttttgctcttgttgcccaggctgaagtgcagtggtgcgatctcagctcactgcaacctccgtcttctggtttcaagtgattctcctgcctcagcctcctgagtagctgggattacaggtatccaccaccatgcctggctaatttttgtattgttagtagagacggggtttcaccatgttggccaggctggtctcgaactcctgacctcatgatctgcccacctcggcctcccaaagtgctgggattacaggcgtgagccaccgcacctggcctgcccagctaatctttaataaactttttatagaaacagggtctcactgtgttgcccaggctggtcttgtactcctggcctcaagtgatcctcccacctcagtatcccaaagggttgggattgcaggaaggagccgctgtgcctggtcaagactgagtcttataaagcaacataatcatgggaatcatatcctatcactttgtcacatgctattggttagatgcaaatcacaggtcccacccacactgaaggagagggaattacataaagacttgagcagcaggaagtggggatcatgggagaggagactatcttaaagtcagtctgccttgcaaaccaagctcctgttcccatggagcttacgttctagtaggggaaacagacaaccaatgaataggcaaataagtgcatgctgggtgctaaaaataagtgctaaagccaaacagtaaatttgggtaaatggagcagatgtaaaggagtgttactgtagaagacagcagtcagggaaggcctctggggcagcaacatttgagcagagacctgaaggaaatgaggaaggcacagagattactgggaaaagaggcaccagcctccaatgagcatgtgcacaggccctgccaagtgagcatgctggagggttctgtaacaatgcagagacccatgtggctgcagcacagtgatccagtagcaggatgcaaggctagagaggagatggggttggaccagatagggccttgcagccgtgttaaggatctgagtgtgatacaaagacattaggaaacatggggcagaggagaaacactggctttccattgcaaaggatcactttgatcctgggataagaacagatggatgagaggcatggctggaaggagagaaaccagtcttaatcatttcagcgagaaacactagtagtttggacccaagtggtgcatttcctggaaagtaggcagctgtcatctaaaggaagagcctgcagcatcaatggtaggttggatgtgtggtgagagtgaagaaaacgttaagggtgatgccaaggattttggcctgagtcacttgaaggatggggtcatcatttattgaaatgcagaagacagtgagagaaatgggttcgaacagaaaaaaaatctggagtttgatttgtttctttttgtattttttctgggagacaaattgttacttacacttgttagcggattctgacttccatgcctaccatcctgcttagagtttgattttattatgtgctgtaagcaaagtgacgttgtcattcttttttttttttttttttttttttggagacagggtcttgctctgctctgtcatccacactgcagtgcagtggtgtgaacacagctcactgaagcctcgatttcctgggctcaagagattccccagccttggcctcgcaaaatgttgggattacaggcggaggaggttccaagcgttgatgtggatgattccagaccaacagttggaaagatatgcagtagcctagacaagaactaggcaagtagggttggggtagaggcttccagcatgtcctggagatataatacggaaggtctggggttttttgaatgtaggaggatcaggaaggtcatacttgtctcctaggcacaaagcagaaggtgactgtcaaaacaaaacaggaacaatagtaaaactgggttctagaaaagagccttggaaacttcttttgtgaccaagtaactctttttcgagaaggcctggactgtgtttcaagctatgtaggcgctgctaagagaacattctggagtacagtgttgacatttagtaagggcctttgtctttttatttcttttctttttttcatgctattctgacagaagagcctttgtccgccggatgcggtggttcacacctgtaatctcagcactttgggaggccgcggtgggcagatcacgaggtcaggagatcaagaccatgctggctaacatggtaaaaccccatctctactaaaaatacaaaaattggctgggcgtggtggcgtgtgcctgtaatcccagctacttgggaggctgaggcaagagaatcacttgaactagggagccggaggttgcagtgagctaagattgtgccactgcaatccagcctggcaacagagcgagactctgtctcaaaaaaaaaaaaaaaaaaaaaagagccttagtctttcaaaacagaaatttgcatggttggattgtttaatgacagaagaggtagcaaatgtcagtgagcaccttctcctttatccatagactacattgcaggggtgagttaaaaagaaagggtaacatggggccaggcacggtggctcacacttgtaatcccagcactttgggaggctgaggtcagagttcaagaccagcctggccaacatggtgaaactccatctctactaaaaatacaaaaaattagctgggcgtggttgagggcacctgtaatcccagctatatgggaggctgaggcagaagaatgatgtgaacccaggaggcagaggttgcagtgagccgagatcattccactgcactccagcctgagtgacggagcgagactccatctcaaaaaaaaaaaaaaaaaaaaaaaaaaaaaacgtaaaatgcacagcactgctagggtgttgcatcttgtttgagtttctgggctttctctccactagagtggccgcccagagaccaacacttgctttgcgtacctctggccaagggcgctacttcctctagtaacaagaaagatgatgggaggatgggaggagctgcctccatggccttgtgaaaacctgaatctgaaaaatgtctgaatttgttaaagaccagtccaaaaatttgagaaaatgaactcattctgggagtgggttttttccactctcattaggctgagctaccaattctttttgggggccttagtgcctgccatggtcaagttctatagaaacaccactcaacacagagttacccagaaaaggcaaagctatcaagatagaaagtagattagtggctgcctagggctcaagtgggtaaaggagtgactgcaaatgaaccttaaagatctttctggggacggaggtattttaaagttggaatgtggtgatgattgcacagctctgtacattcactaaaaattattgaattgtacacttaagatgggtgaatgtcacagtatgtaaattaaaataaatctcttttaaaaaatatttaatcagccaggcgcagtgactcatgcctgtaaccccagcacttggggaggccaaggcgggctgatcacttgagctcaggagtttgagaccagcctgactaacatagtgaaaccctgtctgcaccaaaaatacaaaaattagcagggcgtggtggtgtgcccctatagtcccagctactagggaggctgaggtgggaggatcacttgagcctgggaggcagaggttgcagtgagccaaaatcacaccattgcactccagcctagatgaggagagtgaaaccctgtctcaaaaaaaaaaattaattgacaaataatcactacatatctgtgtgggatgcaatgtgatgttttgatatatgtacacattatggaataattaaatcaagcatatccatcacctcacataatttttttttgtggtgtgaacatttaagatcagctctcttggtcagatgcagtggcttacgcctgtaatcccaacactttgagaggccaaggcaagaggatcacttgagccaggagtttgagaccagcctgggcaacatagtgagaccctatctctacaaaaaatacaaaaattagccaggcgtggtgccatgcacctgttgtcccagctacttgggaggctgaggtaggaggatcacttgagcccagaatattgaggctgcaatgacctgagaccatcccagtgcacaccagcctgggtgaaagagcaagacactctcaataaaataaaatttaaaaataaaataaaatcagttctcttataggtcttgaaaacttattcttctgtatagttgaaacttcataccctttgaccaacatctccccattgccaccccccaccaatagagctcttaaaacactcactgtattagtcagggttctccagaaaaatagaccaatatgattgatcaatctatctgtctatccacctctatctctatcactgtattatcatctatgatgtattttaaggaattaactcatgcgattatggaggctgagaaatcccacactctgcttctgcaaactggagaccctggaaggctggcggtgtaactctgagaactgggaatctgatggtgcaagtcccaggagagggcagaagactgatgtctccactcaaccaatcaggcagacagagcaaactctccctcctctgcttctgttgttctattcaggccctcaatggattggatgacaggactggatgaggacccccacactggggagggccatctgctttactcagccactgattcaaatgccggtctcattcagaatcactctcacagacacaaccagaaataatgttttacgtaggcactccatgccccaatcaagtcaacacataaaaataaccatcacgagtctaccccttgtcaacttgacactcatcctcatctcctgaaaccatacttaatctccaaataatgacaataacaagataataattctgcctaatatgatacatctatcctgtgtgccaccgaaaatgcacaaactctttcccagaaaaggataggaatgagtgatgtttagtcttctctttgatattcttctgaaacttaaagactgtgatgttgcggagacaaaagtgagtccatcttgaatgctgatctgccatactgacttcttactaaccccagtctcatgaatgcctctgattcctactttatttactgtccttggtgtaagaacatgtacacactataaatcctgcctttaggtcaaggcaaccttgatattaccacacaaatcacaggctatgacgcacacagcattcttgcctgttctggagggctgctgtgttaggccgtccctgcattactataaaaaatacctgaggctaggtaattcgtaaagaaaagaggtttgggctgggcgcggtggctcacgcctgtaatcccagcactttgggaggccaaggcgggtggatcccctgaggtgaggagtttgagaccagcctggccaacatggtgaaaccccgtctctactaaaaatacaaaaaaaaaaaaaaaaaattaaccagatgtggtggcaggtgcttgtaatcccagctacttgggaggccgaggcaggagaatctcttgaacctgggaggcggagcttgcagtgagctgagattgcaattctcccacctgcaggctgcaggctgtacaagcatggctctagaatctgcttctggcgagggcctcaggaagcttacaattaccgtgggagctgaagggggagcaggcatgttacataaataaagtgggagcaggagagacggggaaggggtgggtgccatacactttcaaacaacaagatctcacatgcagtcaggtgagagctcacttatcaccaaggggatggtgctgaaccattcatgaggggatctgcccccatgatccaatcacctcccaccaggccccacctccaacactgggaatcattgcaacatgagatttaaaggggacaaaaatccaaactatatcagttgccttgaattgtctctatagagcatagagcccctttccctttggtaggtgagccttgtgtctggggaggaatcgtgctgagatctacctgtcttgctgatgctcaagactaaactactgtgtataagttccctcataaatcacccttcattgacaaactggttcatctgcctcattccttggtttctctgttcctttggcatttgagggctgctttgcatatatgacactttcatagagcagatgtaaaatttttgttgttattgttggttttttgtttgttttctatagagacaaggtctggctctgttgcccaggctggagtgcagtggtgcaatgacagctcacagcagcctcatcctcccaggctcaagcgattcttccacctcagccttctgagtagtcgggacagcaagtgcatgccactacacctggatactgttttttgttttttttctgttttgtttttagtagagatgaggttttgccatattgctcgggctggtttcgaactcctgggctccagcaatttgcctgccttggcctcccaaagttctaggattacaggtgtgagccaccatgctcagctgttgttgttttctgagataaggtctcactctgctgcccatgctggagtgcagtggcatgatcatagctcactgcaacctctacctcctgggctcaagagatcctccctctacagcctcccaagtagctaggactacaggcaagtgttaccacgcctggctatttttttttttaatttttgtagagacagggtctccctatgttgcccaggctggtcttgatcttctgggctcaagtggtcctcccacctcagcctctcaaagtgctgggattacagacatgaacaaccacacgcagccagatataaaattaacaatacttaaatcctatgatacaaagtcaatacatcttatgttacatgataaaatgagaggaaagaaaacaaagatatttgctacacaaacgtgttcataataaaataaggaggaggccgggagtggtggctcacacctgtaatcccagcactttgggaggctgaggtgggcagatcacgaggtcaggagattgagaccatcctgggtacgggtgaaaacccgtctctactaaaaatattaaaaaaaatattagccgggcgtggtgatgggcacctgtagtcccagctactcaggaggctgaggcaggagaatggcattaacccaggaagtggagcttgcagtgagccgagatcacgccactgcactccagcctgggtgacagagggagactccatctcaaaaaataaataaataaataaataaataaataaataataaaaaaaataaataaataaaataaggaggaaatataacaattacagtcctcatttctgtaaccagtcatgtggtcatggctgtgtatttatttataactatcttcctccactaccccattctgtattccttttgccttcagcaaacacctcaggtggtcatggttctttatttggtgttgtgatccaaaccttcattcctgaaggacctgggccatatatagtcctgtctggattggattgttgtatatttttccgttccacttaatcagagggcgtggtcatactgagagatgctctgcaggatctcatgaattgcagacatactctttcttacctccattgtggagtagtagtccaagtttcccttggtagtcagaatcaatttatctagccactagaggattcccttctttttttgttgattcagggtattaaggagcccaaagtggctgggcagtagccttaacttccagctcaatgcaattattgttgtgtctccagatggaagcattccttcttctggaactaagagctctagaccagcagagcataaagttgtgagaacaggaaccaaaaattttgctactgggtcactagaagtaatagtggttcagctgggcacagtggctcatgcctgtaatcccagtgctttgggaggctaaggcaggaggattgcttgaggccaggagtttgagaccagcccaaacagcatagggagacactgtttctaatatatatatatatatatacattttttttctttgtttgttaaacaagctgggcatggtggcaagcacttgtagtcctagctacttgagaggctgaggtgggaggattgcttgagcccatgagtttgaggctatagggagctatggccatgccactgctctccagcctgagcaacagagcaagactctgtctaaaaaaaaaaaaaaaaaaaaaattggtgaagggtgccactcccatttccacccttgattcctgactgtgatttcctgctgtaagagaaacagcaccatggccaggcgcggtggctcacacctgtaatcccaggactttggtagtccgagccgggtggatcacctgaggtcaggagttcaagatcagcctgaccaacatggcaaaacctcatctctactaaaaaatacaaaaattagccggtgtggtggcaggtgcctgtaattccagctactcaggagactgagtcatgagaatcgcttgaacccgggaggcagatgttgcagtgagccgagatcacaccattgcactccagcctgggcgacaagagggaaactctgtctccaaaaaaaaaaaaaaaaaaagaaagaaagaaaaaagaaaaacaaaacaaacagcactgtttttggacgctgattcagagcatatacagccttctggtgaaccttgccctagccctcctagctggtactgtaactaagtcttcaaaagaccctttcactgtttcatcaaaccagctacttcagaatggtgggaaaagaccagtgaattccatgagcttgaacccattgctgcattccttttgctgtgtgttcgttgatgagaagcaatgttgtgtggaataccaataccattacaatggataagacattctataagcccacaaacggtagttttggtagaagcattgtgtgcagggaaggcaaattaatatgctgagtaagagtttattacaagcccacacagtggtgtgcacctgtagttctagctacttgggaggctgaggcaaagtgggaagatttcttgagaacaggagttcaaagctgtagtgtgctataatcatgcctgcaaatagccactgcactccagcctgggcaacacagcaagatcccatctctaaaaataaaaaataataattaaaaaaaatttttaaagaatctattacagtaagaacaaaacactgtcccttccatgatagaagcagtccagtgtaatcaacctgccactggggagctggctgatttaccccccggggaatatcagggactcagtcttggtctctgctgctgatggattgggcactcaccagtggccatagccaggtcagctttgataagtggtagtccatattcccaagcccatgattaacctccatccctgaccatggccactctgctcatgagcccactggctgatgagggggtggctggagaaagaggctgatggctatccacagaataggtcatcctatccacttgatttttaaagtcctgctctactgaggtcaccctttagtgagcattcacatgggagacaaatatcttatgatttttgctcattctgcgaggtctattcacatacctcttctccaaatttccttgttaccagttttccaatcatattccttccaagttcctgaacatccagccaaaccatggtccacagcccatgggattggtatataattgcgtgtctgaccatttcttcttccaagcaaagcatgctgcctgaagttttgccactgggaagatttcccttcactgctgtccttaagggatgtctcagagagaagctgtagtgctgtccactttcagatggcacacacgtattgtgcagaaccacctggaaaccaggcctgtcctatcttcctctgtcagctgattatagggacctccctaagaggccataggtacagaacgggagacagaaggcagtgtagcggggcgggggaccgttggtatttgtgccagtccttcattaacttacttgtgccttcagggcctgcttgaactcaatcatgtatataccacttccatttgatggtggagtgctcctgtgcacatccaaatttatggcattggagatcagatagcccccagtttgtgatgggtagctcaagtcgcattgtaacttggtggccatggttgagcattcagtctttttttttcccgagatggagtcttgctctgtcacctaggctggagtgtaatggcgcaatcctggctcactgcaacctctgcctccagggttcaagtgattctcctgcctcagtctcccaagtagctgggattacaggcacatgccaccatgcccggctaatttttgtatttttagtacaggtgggctttcaccatgttggccaggctgacctcgtgattcacccacctcagcctcccaaagtgctgagattacaggtgtgagccaccacgtctggtcaagcattcagtctttaccaaggctcaggagcaggccaagagctgtctcaaaaggaaagtaagctgaaggatggcagggctctgctgcaaaattctaaggatctgagctataatccacctacaggaacctgctaaagactccaaacagcacccctgtctgccactgacccttcaggcaccattggctctgctggatcatatggcccaaggggcggagcagcttgcacagcagcctggacccattgcagagccttgtccgtttctgagtcccactcaacacttgcagctttttgggtcacccagtaaatagattcgaatatcacacctaaatgaagaatatgttgcctccaaaatccaaagatacccacggggcattgtgcctgtattctgcctgtaggaggggcagatgcaacaacttctccctcaccttagaagggacatctcaacatgccccacaccactggatctctagaagtttcacggaggtagaaggcccttgaatttttgttggatttatttttcaccctctgacatgcaagcgtcttgccagtgagtgtagaatagttgatactccttgcttcctgggtccaatcagcacggtggcttcagtgtaatggaccagtgtgatgtcttgtggaagggaaaggcaattctttgggaatttaattttgttttatttttaataatttttgtcatacatagtaggtgtatatatttatggggtacatgaaatgttttgatacaggcatgtaatgcataatgattacatggggaatggggttccatccccttgagcatttatcctttgtgtaacaatccaattatagtttcagttattttaaaatgtacaattattgttgactatagttaccctgttgtgctatcaaatagcaggtcttattcattctttctaactactgtttttgtacccattaatcatccctacctcccacctcccccactaccctacccttccaagcttctgataatcacccttctactctctatgtccatgagttcagttgttttgatttttagatctcacaaatgagtgagaacatgcaatgtttgtctttctgtgtaaattttgacatagggctagagagttcacatataccccccaggcaggacctgaaggtatattgctggcctgcctgctgaaagaaaactgctcttatgggcctcatggacaggaatttgagggaaaggcgtttgccagttcaatagctgcaaaccaggaaccaggggatgtgttaatttgcttaagcaatgaaaccacatctgatacagcagctgcaattggagtcaccacctggttaagcttgtgataatccaccatcatcctccaagatccatctgtcttctgcacaggccaaatgggcaaactgaatgggaatgtggtgggaatcatcacccctgcatccttcatgtccttgatggtggcactaatctctgcagtccctctaggaatgtgttatgctttgggtttactattttcctagttcaggccagctttagtagcttccacttggcctttcctcccataatagccctcactctgcaggtcagggaaacaatatggggattctgccagcttctttgtatgcctatttcaattacacattctggaactggagaaataactgcagaatgggttgggacccactgggtccactgtgaggcagacttgagctaaaactccattaattacctgacctccataagcccctactcccactggtaggccacagtggcattttgggtaccccagaattggtaacagctcagagctggtgtctagtagtccccaaaagttctgattatttccttcttcccaatgcacaactactgtggttacaggtccctggctataggtccctttggggaagactgggaaaaagattaatagcatacatttttattagccaggcacaggggtttgagcctgtagtcccagctagtcggcaggctaaggtgggagaatcatttgagcccaggagtttgagactgcagtgagccatttaatcccagcagtttgggaggctgaggtgggcagatcatgaggtcaagagtttgagaccagcctggccaacatggtgaaactccgtctccaccaagaatacaaaaattagccaggcgtggtggtgggcacctgtaatcccagctactgcactccagcctgggcaacagagtgagactctgtctcaaaagcaaaaacaaaaacaaaacaaaacacacacacacaaagatagatttttaggagtactggggttattcttcaacaggtccaggtatccccttcattcaagtggtcctgggtcagtaaagtggctgatgtccagcaattcactgaggggttatgaatcaatttttatgatacatgttaaacttttgttcatctgacctagaaattttctgcatatacagatcaagtaagaaaatatttcacttctaggaacaccctgataaacttgccaatgccaaaggtcttcatgagtcagactattctgattgctgccttgattctgctgttcatcatggcaaccacaccccccttgcctctgttggttgagtcccaaaacttggaacctgccactctgggcaggggtgggatccaatgactcccattgcatttaggcttcccgattctgtgagtgcagtttccatcgaaaggccaggcctacagagtagggtgatcacagagctctccaaggatgtgctcccctcatgatgttatgtttcacggtactagtgaaaggtgtgtcttttgaaccttcccagtgtgggtgaataggccttaaatgacaaattcactctagcatgccaatctccctaagcttctgaattcctttccctacataaaaccaaggcaggtacggcatttccaatttgctcaccatggaccaggttttggtccatgttttccatgtttgagccaaccaactgaagtgttagagctttttcttttctttcctttttttttcccccaagacagagtcttgctctgtcacccagactggagtgcagtggctcgatctcagctcactgcaacctctgcctcctgagttcaagcagttctcctgcctcagcctcccgagtagctgggattacaggtgcccgccaccacatctggctaatttttgtattcttggtagagacagggtttcaccatgttggccagactggtctcgaactcttgacctcatgatctgccctcctcagcctcccaaactgctgggattacaggcgtgagccaccttgcctggcctttttgtttgtttgtttgttttttgacagggtctcactctatcagccaggccagagtatggctcactgcagcctcgacctcccaggctcaaatggtcctcctacctcagcctcctgagtagcttggactacaggaacacaccatcatgcctggctggctttttttttgagatggagtctcactctgtcacccaggctggagtgcaatggcacgatcttggctcactgcaacctctacctcccgggttcaagtgattctcccacttcagtctcctgagtagctgggactacaggtgcatatcagcatgcccagctaattttcatatttttagtacagatggggtttcactatattggccagagtggtctcaaactcgtgacctcaagtgatctgcccacctcagcctcccaaagtgctggggttacaggcatgagcaactgtgcccagcaagtaatttataaattacactttaccataggtatgtgtatatagaaaaaagcatagtatatgtagggttcggtactaaccacagtttcagtcttccactgggggtcttggaacatattcccttaggctaagaggggactactctacttgagttttctaatttatatggacagaaatgggagagcatgtgtgagaatggatactaagggtatgcgatgatggtggaaagaacataaggttgggtcaggctaaattaattgatttgggcccactaagcagagattctgcctttaattcttcagtttagggagttagaaaggctctacgacaggtgtggtggctcaagcctgtaatcccaggatgctgggaggctgagaagacaggatcccttgagcccaggactttgagaccagcctgggcaacatagcaagaccttgactgcactaaaaaaaaaaaaaaattaggccaggcatggtggcttgagcctgtaatcccagcactttgggaggccaaggcaggcagatcacctgaggtcgggagtttgagaccagctggtgcaacatggcaaaactctgtctctcctaaaaaaaaaaaaaaaaaaaaaaaaaaattagccaggcgtggtggtgtgtgcctgtagtcccagctactcaggaggctgagacaggagaatcacttgaacccaggaggtggaggttgcagtgagctaagattgtgccactgcactccagccgggtgacagagtgacactctgtctcaaaaacaaacaaacaaacaaacaaaaattaggcaccggaagagattaacaataactaataataaaatagaacaattataacaacatgctgtaatgaaagttgtcagtcactgtagtctaacttgcaatttgaggtgtgacagcaaaactagcatgaatttcattactttttccttcttcacagtttcacagataaaagatttgttcttactatagatcttagcaacctcaacatatgagtttttttctttccttattaagttgagcactttcacctccttacttagaagaagtacttgacagcttttctttggcatatctgaattgccagcatcactactcttactttggggctactattgagtgaaataaaagccacttgcacacaaacactgtgataccatgacagtcaatctgataactgagacagctactaagtgaaaatgagtgaatagcatacacagtgcaggtatgctggacagagggatgattcgcaccctgggtgggatggtgtaagttttttttttaatttattgtgttattttatttatattctttatttcttttaaacaaccctaagtccatttagcaatgacacgatattttatcacactactcagaacaacacgcaattgaaattatgagttggttgggcatagtgattcatgcctataattccagcgttttggaaggccaaggtgggaggcaccattgaggctaagagttcaagaccaacgtggacaacacagtgagaccaccatctctacaaaaacaaaacaaaacaaaacaaaacgatacaaaacaaaaaaattggccaagcttggtggtgcacacccgtagtcccagctaacttgggaggcaagatgggaagatggattgagcccaggagttcaaggctgcagtgagctatgatcacaccactgtactcaagcctgagtggagagcaagaccctatctgtctcaataacaaaagaaaacaaaacaaaacaaaaacagaaaaaaaagtatgagttgcttacttctggaattttccacttaatacttttgaatcatggttgactgtgggtaactgaaactgtggaaagcaaagccatggattggggggactgctgtagttcttttggagcatcgcatccctcctcttgggtcacactttgtacttcgccttagggacctactggtacttgggtctagttacaggtctagaagcaaagggggttgttgaggtggtcccgtaacagaatcagcatagtcttgcctgtcaactgcctcagtggaggcctttacagtttcctcaggcaatgcagagttaattccctgagatggggctgggagagtgatggggagacccataccactggggtagggaggcctcttccactggcaatggagatacatcagactttcggggctcaatgtctcttatcaaggtcttcccgcacatccctatttcaatttccaggatcctattgtttcccaatcaatatgctcactttaacagtagatgccctgtgaggctggatacaattcagtcagtcacagaatgaggttctgcatttgattttcagcagtctcagctctgtggctataggagacagaagtcttcttcaggctcacatacgagctctaaagaaatctgctttaccaacgctgtcacagatacacccagaaataatgtttaatctgggcaccctgtatcccaataaagttgacacataaaattaactatcacacaccaagaccccaaagtggcttgtaaactgagcaagtttgtttctagaacagtagaaataaaagacattttggctgggcaaggtggcttatgcctctaatcccagtgctttgggaggctgaggcaggagggtcgcgtgagtccaggaattcaagaccagcccatggtaaaactctgtctctaaaaacaaaaaacaaaaaacaaaaaaaaaaaaaaaagaaaagaaaaaattagctgggtatggtggtgcatgcctttagtcctagctactcaggaggctgaagtgggaggatcatctgagcccaggaggttggtggaggctgcagtgagccatgattgggccactgcactccaccctgggtgacagagtaagaccctgtctcaaaaataaataaataaataaatttggattaccctgaacaagatacaagcttcaacattgctaattatttttaagtctcactgaaaaatatttccctacttggaatcctcctggtatttatgaaggagaaaaataacatgaaacaataacatatattttgtgcaaaaaggggaaggtttgtaaatggggcctaagattattcataactggagcaaatgcttcataatgtaaatgatgaagatactaatattaagaaactattatttatggtttttactaactccagaataaagtactttaatcacatactgtcaaaaatttagttgtaatgacagcttgtttttttgagacagggtcttgttctgttgcccaggctggagtgcagtggcaggattatagctcaacccaggagtaaccttgaacttctgggttgaaggaatcctcctgcctcagcttccacagtagctgagactactggtgcataccccaccacacccagctaattttgtcttattgttatttattattattattattattttgagagggagtttccctcttgttgcccaggctggaatgcaatggctcgatctcagctcactgcaacctctgcctccaaggttcaagtgattctcctgcttcagcctcctaagtagctgggattacaggaatgtgccaccatgcctggctaattctgtatttttagtagagacagggtttcaccatgttggtcaggcttgtctcgaactgctaacctctggtcatccgcccgcctcggcctccctaagtgctgagattataggcgtgagccaccacgcccagcctattttattttttgtagagatggggggtctcatcatgttgcccaggctggtcttgaactcctggctgaagcaatcatatcctcctcagcctcccaaagtgttgggattacaggcatgagccaccacatcctgccttaatgacaattattaataataccaggtagtagttgtggaatttccctcctgttttgttcaagttaataaatcaaggccgggcatagtggcccacacctgtaatcctggcactttgggaggtcaagatgggaggattatctgaggccagcagttcaagaccagcctgggaaaacctgcagatttaccagggaagtaggaggctggactaacatagtaatgccagcccaggtgggaggattgcttgaggccagaagttcaagaccagcctgggcaacgtaggaagacccccatctctacaaaaaaatgaaaaaattggcctggcatggtggcacatgcctgtagtcccagctacttacaaggctgaggcaggaggatcacttgagcccaggagttccaggatgcagtgggctaaggtcacactactgcactctagcctgtgacaaagtgacacttcagttctaaaaagaataaataactaaatgaaaacacatttaaatttgcatgattcttgggtagttttctttcttatttctctactaaatttttactctgtagaactttggcatttcagtaaatcttacaagttaagactatcaattcaacatctttcttgcctaggaagaaaaatattgagaatgaacggggtgctaaattgtggaggaacatgtctggggttgtgatagctgcgttttttggcttatcaatgttgacgattttcaagactccaataaatgtctgctcttttgttctaaatagcaaaatgaaaacgctgagtaaaattgattattgaaattggtgttgtctattttttaaaatgcagtagtagattatttgggataaaacattgaagatttgttggggaaagtgaatgcagttgttccttgaactgtgtgagttcacttatatgtggatattttcaataaatatatgggaaaaattttcagagatttgggacaatttgagaaaacttggagaatagcctagaaatggcaaaaaaaaaaaaaaaaattaaaaaagttggccaggtgcagtggctcatgcctgtaatcccagcactttgggaggccaaggcgggtggatcccctaaggtcaggggttcgagaccagcttggccaacatggtgaaaccccacctctactaaaaatacaaaaattagctggatctggtggcacacccctgtaatcccagctacttgggaggctgaggcacgagaatcacttgaacccaggaggcggaggctgcaatgagccgaggtcacgcccctgcactccagcctgggtgacagagtgagactctgtctcaaaaaaaaaaaaaaaaattaagaaaagtcaggtaggaatgcacaagatatgtgtagacactagtgtattttatcatttactaccataaaatatgcacaaacctgttataaaaagttaaaatttggccagtgcggtggctcacacctgtaatcccagcactttgggagactaaggcgggtggatcacgaggtcaggagctcgagactagcctggccaacatggtgaaaccccgtctctactaaaagtacaaaaattagccgggtgtggtggcaggcacctgtagtcccagctacccaggaggccgaggcaggagaattgcttgaacccgggaggcagggattgcagtgagccgagatcgtgccactgcattccagcctgggcgacaaggcgagattccatctcaaaaaaaaaaaaaaagttaaaatttgcccaaactgatgcacaaatatacttacagattatacatggcatcactcacagttgaaaaaaatgtaaacaaacaaagatgcgatagtaaatcataactgaaaaaaattacctgtagtacatagtgcagtactataataattttgtagttacttctagttgttattgagaacatctgcttaaaacaccaggtaccattaatcatctgtgtgagcagttgtctctttggcaaactgtacagagcagtgaaaagtgatctctctcagttctcgagtagaaaccttgtatcacttatgggacccattctaatgatgctggaagtgctcccaaggagcagaggaaagtcttgacattagaagaaaaagttgaattgcttgctatgtaccctacccagattgaggtctgcagctgtgggtgcctgccatttcggatagatgattcgtcctgtaaacagatgacatgaagttaaggtatcaacaaatatagtacagtactgtaaatgcattttatcttccttataattaatttattttgagatagggtcttgctctgctgcccaggctggagtacgggtggcacgatcttgactcactgcaacctctgcctcctgggctcaagaaatcctcccgcctcagtctcctgagttgcgactacaggtgtgtgccaccacagccagctaattaaaaaaatttttttgtacagatgagatttcactatatgctcaagctggtctctaattcctgggctcaagtgatcctcccacctcagcctcccaaagtgctgagattacaggcatgaaccactggggctggcctcttataatttatttagtaacattttattttatttccttttttttacattttattttctttagcttactttaagaatacactataggctgggggcagaggctcatgcctgtaatctcagcattttgggaggccgaggcaggcggaacacctgaggtcaggagttcgagaccagcctgaccaacatgaagaaatcccgtctctaataaaaatagaaaaattagccaagcgtgatgatgcatggctataatcccagctactcaggaagctgaggcaggagaatcgtttgaacctgggaggctgaggttgcggtgagccgaaatcatgccattgcactccagcctgggcaacaagagcgaaactccatctaaaaatatatatatatatataaaataattttttaaataataatataaaatagtataaaattatttacattttatatcactatataatatataaacatagtctcactatgttgcccaggctggtctcaaactcctggactcaagaaatcctcccacctcagcctccaaactgttggaattacaggtgtgagctatggtgcacagcctggtttttttttttttagagacaggatctctctctgttgcccaggctgaaatgcagaggtgtgatcatagctcactgaagccttgaactcctggcctcaagcaatccaccggccttggccttccacagtgctgggattacaggcatgagccaccacacttgtctagtagttaaaattttgaggaatcaaaagttatatgctggccaggtgtgatggctcacatctgtgatcccaacattttgggaggctgaagtggggaggactgcttgaacccagatgttcaagaccaaccagggcaatatactgagaccccttctctaaaaaaaatagaaaaagttaggtgggtttgacagcacgcgtctgtagtcccagctactcaggaggcagaggcaggaagattacttgagctcgggaggttgagactgcagtgagccgccatcatgccactgcattccagcatgggcagcagagtgagactgtgcctcaaaaagaaaagctacacgccgattttcaatagtgcgactgaggtcattaccccaaccctgaattgttcaagggtcaactgtacattttagtgtatgcgaaatacccaactgttttactttgggctgcataatttttttctttaaaaatttttttttcttaaaattgatggggtgcccaggctgatctcgaactcctaggctcaagggatcctcccacctttgcctcccctgtagctgagatgataggtttgtgccaccatgtccagggagctgattgattgattgattgattgattttgagatggggtctcactctgtcacccaggctggagtgcagtgttgtgatctcagctcattgcaacctctgcctcccaggctcaagcgatcctcccacctcacctcctgagtagctgggactgcaggcacaggccaccatgcctggctaattttttgtatttttaggagaaacaacatgttgcccaggaaagtttcaaactcctgggctcaagcaatctgcccaccttggcctcccaaagtgctgggattacaggagcgagccaccgcactcggccccagctgaatgatttttaaggtaccttccagaagacatgctttataattctataccatggcacacatccgacactcaatcacagtgcctcatcttgttgcacccagagcaggttcctgacccagggccttggtgtttgccatcccctctgtctaatggaccattccttagatggtcacagcccactcctttgcttaccgctcggctcaaatatcgcttcctcagagcagccttccctgattagcctatctaaaaatagcatactgtcactgtcctttagcctgccttctttttcttcatcgcatttaccactgtctgactttataggcttcccttgctcactggcaaactaggtccaccagggcagggacctcatcagaattgttcgttgctgtatccccagaatctggcatctaatagttgctcaagaccatatttattgaattaattgaatgaattgcaatttgagtttaaatatttacttctttttgcctcctcaaccagacaggaaattcatggaaggcagccaaaggccctggttgcttatttatctcctctaaagcaattagctcaattctgcatgggtgacagacattcaaccaagatttgctgaaggccttgaaacaaggataagttacacagctaaccaacatgcattctttccaggtgaatgaacacagtaatgccttgtctttaggcccacacatcacagtctacaaagtttttatttttatttttgagacaagagtctccctttgttgcccaggctggagtggagtggcatgatcttggctcactgcaacttccccctcctgggttcaggtgattctcctgcctcagcctcccaagtagctgggattacagacacacgccactacgcctggctagttttttgtacttttggtagagatggggtttcaccatgttcaccaggctggtcttgaactcctgacctcaagtgatctgctcacctcggcctcccaaagtgctgggattacaggcatgaaccactgcgcctggtcataaaggttttttgtttgtttgtctctttgtttgttttcagacagagtttccctcttgttgcccaggctggagtgcaatggcacgatctcggctcactgcaacctccgcctaccaagttcaagcaattctcctgcctcagccccctgagtagctgggattacaggcatgcaccaccatgcccagctaattttgtatttttagtagagacggggtttctccatgttggtcaggctggtctccaactcccaacctcagatgatccacccatctcggcctcccaaaatgctgggattacaggcatgagccaccgtgcccggcaccacaaagtgatttttatatttttttctatagaggtggggtcttgtcatgttgcccaagctggtctcaaactcctgagctgaagcaatctgcccactttggcctccagaagtgctgggattataggcttgagccactgcacccggcctacaatgtatttttatgtatgttaactaatttttagcattttgccaatactttagtagttcttaacctttgcctgaggaaatcagcactcaaatataacaaatgttaatttcttgcacatgctattactaattttgagtaccttgaaaaaacttagatatcaatggcatttaatgtgttctagaatgtctgaataaatattttattttatttatttttttgagacagggtttcattctgtcacccaggctacagtacagtggtgcaatgtcggctcactgcaacctctgcctcctaggttcaagtgattctcctgcctcagcctcccaagtagctgggattacaggtgtgcgcctatgaggcccagctaatttttgtgtttttagtagagatggggtttcaccatgttgtccaggctgctttcaaactcctgacctcaagtgatccatctgcctctgccttccaaagtgctgggattacaggtgtgagccaccgtgcctggtcctaaagaaatattttaagagactggaatatatacctgtatttcaacatgtacatatgcatggagagatttttggatgaatgtttaacaattttcacagtgggcatttctgttggtgggaccttgataacatctgtttttttttttttttgatggagtctcgctgtgtcacccaggctggagtatagtggtgcaatctcagctgactgcaacctctgcctcccgggttcaagtgatccttccacctcagcctccagagtagctgggactacttgtgtgcgccaccaccccggctacattttttgtatttttagtagagatggggtttcaccatgttggtcaggctggtctcaaactcctgacctcaagtgatcctcctacctcagcctcccaaagtgctgggattacaggtgtgagccaccgcgcccagccaataatgtttagtgttttgggctttccattgttcttatttgaattaaaaagaaaaatgttttcctgaccttatgtcttgagattgaatttaaaaattttattattattactattattattattatttttacaggcagggtcttgctatattgcccagactggtctcaaactccaagcctcaagccaccttccggcctaaacctcccaaagcactgggattataggtgtaatccaccatgcctctcctgaatttttttttttcaagcagggtttaagaaaatatatttaaattttttagttttatttccttttcttctcttttgagacaaaaatctcgctgtgttgcccaggctggtcttgaacttctgggctcaagtgatcttcctgcctcagcctcccaaagtactgggattacaggcatgagccactgcgcctggtcatttttatttttatttttaagacaggatctcactcaggctggagtgcagtgtcacaaacatggctcactgtagcctcgacctcctgtgctcaagccatactcccacctcagcctcccgagtagttgggaccacaggcactcgccaccaagcacagctaattttatttatttatttatttatttattgagacggagtctagctctgtcgcccaggctggagtgcagtggcacgatctcggctcactgtaacctctgcctcccaagttcaagtgattctcccacctcagcctcctgagtaactggccttagagatgtgggccaccatgcccggctaatttctttttttaagtagagatggagtttcaccatgttggccaggctggtctcaaactactgacctcaagcgatctgcctgcctcagcctcccgaattgctgggattacaggcgtgagccaccacacttggcctgaaagcatggatcttaagtacccagcatcctgagaagacagagtttacaaaagtatgtaaatcaaatgtatctctgatactttgctgaagaaagccttttacttaacatacttaggatattactatggtgtaactgatgaattagcatctgataatagtttggatatctgtctcctccaaatttcatgttgaatatttttttcttttttattaccttgatcctacgttaaaggaaaaggcccagctcatttttaaattttttgtagagacagaggtctcaccatgttgcctaggctgttctcaaactcctggcttcaagtaatcctctcacctcagtcttccaaagtgctgggattacaggcatgagccactgcatcctgctgagagagagagagagatagatatatatatatataattttttttttttgagacagagtctcactgtgtcacctaggctggagtgcaatgacgcgatctcggcgcaccaaaacctctgcctccaaggttcaaatgattctcctgcctcagccttccaagtagctgggattacaggcatgtgccaccacacccggctaattttttgtatttttagtagagacggggtttcaccacattggccaggctggtctcgggaactcctgagctcatgatctgcccgcgtcagcctcccaaaatgttgggattacaggtgtgagtcaccacgcccggccagagattcaatttttaaaacaaatatgaggtcagcaaacaaaatctatttctatacaatgttttatttttgtcagtgtaaataacacaaaaaatacggctacttattttcctggctatgtaataattagtacatagcaaatttcattcagggaaaacttttttttttttttttttttgagatggagtctcgctctgtcacccaggctggagtgcaatggcgagatctcggctcaccacaacctccacctcctgggttcatgtgattctcctgcctcaacctcctaagtagctgggattacaggcatgcgccaccacacccggctaattttgtatttttagtagagatggggtttttccgtgttggtcaggctggtctcgaactcccgacctcaggtgatctgcctgccttgacttcccaaaacgctgggattacaagtgtgagcaaccgcccccggacagagaaaacttttaatactgatttctagtaaagcaacagcaacaatcaaattgaatgaatcaaaattccgaagggttttttttgtttgtttttggtggacaggaagtaggatttactggggagtattaagagggggcagcacagtggaagccctcacgagggcagggcacgccacttgtccagagggccatgatggggatgtacttgaccccacagtcatctgcgatgagccgcttttcagccaccatgtcttcaaattcatccgcagtgaacttggtgaagccccacttctttgaaatgtggatcttctggcagccagggaacttgaacttggccctgagcagggattcaatcacatgctccttattctgcagcttgttgcagatggacatgataacttggccaatgtgaaccctggccacagtgccctggagcttttcaaaggcacctcgaatatctgcctggagcctacattggcgtagtgcaaggtcaaagacatgaacatacatctgaaaggcctgtctccatggtcccttagagcagcccatacaagaaacaggctgcataaactaccaaggaagctgttgtttgcagctgaagggtctttgtgtgttttccgtatttctggtcgtgctatttattctcttaccaaaaaaaaaaaaaaaagtaaggtcaggcgtggtggctcacccccttgtaatcccagcagttttggagtctgaggtaggaggatcgcttaagtccaggagttccagaccagcctgggcagcgcagagcaacttcgtctctatgccatgttgacgcgtgcctatagtcctagctactcggaggctggggcaagaggatcgcttgaacccaagaggccgagcctgcagtgagctgtgaatgagtcactgaactccagatgacagagcaagagttagtctcgaaagaaagaaaaaggtagagcgacacttagttctttgatagttttccactatttgtcataaaaactttccaggatattgagctcccaaaatggaaggccaatatcaggcatcagggacttgttctggacgttggaccaaccttaaagggcccacatagaagctgttcacttactttcttttagtctcttgatttaaaatacttaacattcccctttccttggctttttaaccactgagatttgaaagacatgcaaataacgacctagtggacaatctttgctgatgctaaatcttcattttaggattaaaaggttttgggttttcttaaaatttaatgctgaactcagaagagctttctaaggctgttggtgcaccttagggcaggagagcgtctttgctacgccgcgcaggagtgtgtctgcttctctgtgcatctacacgtgtttgcgtgtccctgtaaagtgggttgagtgtgcggctgcggctttccgcccttggctcacactctcagtcttagtggtctcccccagggctatgcatggggtacaggtttctgtggcctcaggccggggtgaggggtcccccaccccggccagggcgcagcagggcggggcacacgtagccgtgcagggtctcgcgcagcccgcgtcaggaccccggggcacacgctcgggcagggggcgtgtccccacgccaccagaaaaagtgttataggctgtttttttttttttttttttttttaaaaagaaagtgttttagaaagcaggcagaagccaagacgtcaggaagggttgcgagggcccgggatccggcggccacagggatgggaggggcgaggagcgaggggcggagtggcacctcccacaacgcgctccctgcggggcgggcggcaacctccatgcggcctcgtccacgctcagcaccggggaagccgaggcggagaagccgcgcgcgcctcagaagctcccggacgcccaggtacgtgggagcactccacagatggcgcaagtacggttgggccaggcggttgcggccccgtcgcgccgcggcctctgtgacgcacggcgaggcctcccgggctgctgcgcggcgcagcgggggcggggcgagcgcgtgagggcggggcggtggggggggggggcggagcgagaggggcggagccggcagaggccccgccccggggccggaggagcgaggacgctacggagcaggcgcgtctcgctgccgccgctgccgccgccgccgctcgctcttctgtggagccgccgccgccgccgccgccatttgcacggggaccccagtgacaggggctcggcggaggggcggaggggcggagggagggggggagggcccgcggagcccccgagggcgggagcgacgccgccggcgccggccgggctccctgcgcgaccgcgccgcccgcggcgggccccgagcagcagcagcagcagcagcggcagcagcggcagcagcagcagcagccgaggccgggcgtgcgcctgaggcggcggcggcggcggccctgcgggcggccgggaggggcgggggcagcggccgccgccgtttgatggatccgaggatcgcctggtttcagccagagcagctcggaccgtccaacagtctgtggatgcagatctgggagacgacccaggggctgaggaacctctacttcaaccaccactgtcacagcagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtggggtgagtgctggctctgcggcccgatggcctggccggtgcgaatgcgcagccgggcacacgcccacagaggggggttgtgagggtctaggagcggccacccccacggcctgccttcgctgctgttgcacgggggtgctgctggccatccccaaccccccagtcgttcacacctttccccaagcctccttagccgtccacaccctccgtctcctgtcctcccttagtcgtccacaccttcctcccctccctcttaaccgtccacaccttccccaggcccccccctttatccattcactctcctcccatcccccttagttaaacacatctacccttgaccaccaccccgcctccagccctccacacctttttccccatcatcacaactcaagatgagaccgcttagcacgggcctatcattcattccctgagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctcccttcagaagagtccctgtgctggaataggtcactgaatcttatttgttttgtaaaacaaagcttttgggtctcgtgggtgtgtgtgtgtgtgtgtgtgtgtgtgtgtgtgtgtgtgtagcttgagtatggagaaccggctttcaaattgcttttcatttttcaggttgtgttttacattgagggctttagcatgcaaatgaaattaccaattagtaatcccatgtgaaccttttcctggatttattcattcagatctgccctgctttggctgagagagagagttctgtgtacctttttgaaggtctggataaaatgagttggtgggttccatctgcttccagtgggctggtgtctgctctatgctactattacaactcctaccttttgtggaaaatgcagtcaagcgttctaggactggtgctgtggtacatgtcaaacctgccctcacattccagaaagggaacccttttagggttgagtcctctgttgctaagcttcaagggtgctctccatggtcatcacgttttattaaaggcttgtggttccatcctgttagcatttccaagtctacgcgtaaacctgtggtttagtgacaagcaaattgatgttgagggtttctggtagtttcatttcacaggagtaagctccagttaggtaatcactgtcaacgaaaaccttgaagttccttaattgcattttactgaagcctctttgcatgtgtctagcaaaagatataagtccaagatgcttattttttttttgataaattagaaattgtcctctcctctacttgctatttaatgcagaagatactctaaaaggttcatatttatacttagaagcaagatgttcttgttcctgattcaaatatattgccctcaaagggattaggagaggaattttcatttcccggagggattactgtttaaaaactggttgtaaacctctttaaaaactgcttatcacttcaccagattttccattcttttgcctcctcccttagaggatgtcagcagttaattttttttttaaattaaaaaaagttcaattctgagacctcctagtttcaaaaaatacattaaacaattcccaagagtgttaagagtgtctgggtgcttagaaattcttgctttgattcatgtattctgattttttttttttttttgagacggagtttcgctcttgttgcccaggctggagtgcagtggctcgatctcagctcaccgcaacctctgcctcccaggttcaagcgattctgctgcctcagcctcccgagtagctgggattacaggcgcttgccaccacgcctggctaattttttatttttagtagagacggggtttcttcatgttggtcaggctggtctcgaactcctgacctcaggtgatctgcccgtcttggcctcccaaaggactgggattacaggcatgagccaccgtgcccggcctcattatcctgatttcttttttttcttttgagactgggtctcactctgctgcctaggctggagtggagtgacgtgatcatagctcactgtatcctctaactcttgggctcaagtgatcctcctgccttagcttcctggagtagctgggactacaggcacatgtcaccacacctgcctaatttttttatttttactttttgtagagatggggcctccatttgttgcctaggctggtcttcaaccggcctcaagcagtcctcccaccttggcctcacagagtgctgggattataggcatgagccaccattctcgccagtatccttatttcttaactttagaaagtttttctatttttaatataggtatttaaaaaaatctgaattcagagtgcacctcgatgttatgctgttctgagattaaatatactaaaactgttaccattgttttctgaattcttaagatgtgactgatagttagctaataggttaacacattgtggtggttcttggcctctgaactgatagtccagatggggagaggagaccagaaagcatgtgaaaatggactagaaccatgggacagctatatagtctctcgcagctgtcttttgtgttctctgcttccaccaaattggttgatttatttagaatgctgacctcttgcattgcctaagtccttgatgtttttggtttctcctctgaactctcaaaggtactcacttcatgctcttggtatagcccacttatgtttaactttccttttattatgtgttccctcttacacatgacatggacatttctttaatatgtagagtaagatattggatttcatcctaaagtcttcaaaataaaactcttgagctcatcatctcagacttcttcatgtacccacagaccagggattttgtttgctttttaaaacatttttttattttgtgttttattatttttaaattttaatttaattttatggagacagggtctcgctctgttgcccaggctggagtgcagtggtgtgatctcggctcactgcagcctttgcctgggctcaagccatccacatgccttggcctcccagtgtgctgggattacaggtgtgagccactgtgcctggcctaaatttatttttttaattttttttgagacagggtcttgctctgtcgctcaggctggagtgcagtgtcataatcatgggtcacagcagccttggcctcccaggctgaagtgaacttcccacctcagcctcctgagtagttgggactacaggcgagtgccaccatgcctggctcattttggttttttttgtaaagatggggtcttgtcatgttgcccatgaaggtctccaactcctggtccaagtgatcctcccgcctccgcctagcaaaatgttgggattacaggtgtgagccaccatgcctggccttatttatttatttaattatgaatgaatgaatgaattaatgagagggagtcttgctctcttgcccaggctggagtgtggtggcacaatcttggcccactgcaacctccgtctcccaggttcgagcaattctcctgcctcagcctcccgagtaactgggattacaggcgcccgccaccatgcccaggtaatttttgtatttttagtagagatggggtctcaccatgttggccagactggtttcgaacttctgacctcaagtgatctgcccaccttggcttcccaaagtgtcaggattacaggcatgagccaccatgcctggcctggccttttatgttttaagttgcttccactgattctcttgggctttgctcccctccagaactggccatggtttaggatgctgtccacctgctgctgcttgtccatgaaaacgagccataaacccttttcttttgaaagacttaattgtttatcactatggagaaagaggggatggcaagaagtagcaaatacagggaatttgcagaacttggtcttgagccctgggtccagaaacttcttctggaaggtgcttggtgtttgtccaagctcatgataggtttctgttggctgtactgccagatctgtagatgcttttttaaggcttggatgacttgttcaaaacaatgttttggagtacaaatttggctgtggggacatcaagaccttgttgggaaacttgggtttaaggtacaatttcttaaactaggatggtgggaatggggatgtgaagggagaatgaatgtgagaggtattacagggtaaggatggagatgattcagattccttaagtggatttaataatcacactgtagctttgaacttgagtgactggggaaatatttgtggtgtttttggaaataagggccagaaggactattggtttgggtaagaagatagtagggggatgtataggtggacctgctagtggggagctgagatttggagggctgagatgtagtgctcttcactgccgtagggcagtatcctcttgtatgtgccatcctctagtgcccattgttcatcatgtcatagtaagcccaagatgttcatgccttttttcagcactgcattagggcttatatctgcttctctttctctctctctctcgctctcgctccctccctctctctctctttctgttttttttttttttttagacggagtttcacttgtgttgcccaggttggagtgcagtggcgcgatcttggctcattgcaacctctgactcccgggttcaagcaattctcctgcctcagcctcccaagtagctgggattacaggcatgtgccaccatgcctaattttgtatctttagtagagatggggtttctccatgttggtcaggctggtgtcaaactcccaacatcaggtgatctacctgcctcggccgcccaaagtgctgggattacaggcatgagccaccgcgcccggcctctctctgcttatttctacacagtgttaccaatgagattggtgttactgctgggctccaaagcaatcagacagattaaagtagattgaatatgaaagaatttagaggcctttttccaagtgatttgtgctctatttaatttctgtgcatttgcagatatagcccacagtaattcttagtgaactagaaccttcaggttattgaattttactgatttgggtactgacatgcgcttttaagaagacattaggttttctatagtgtagattgtacactaacaatataattcatatttaagaatgtctcaaaatttagtatactgtgttcaactaacttaactttctttgttttttttgttttgttttgtttttgttttttgagacggagtcttgctatgccacccaggctggagtgcagtggcgtgatcttggcttactgcaacttcaacactcctgggttcaagtgattttcctgcctcagcctcctgagtagctgggattacaggcacccgccaccacaccggctaatttttgtatttttagtagagacggggtttcgccgtgttggccaggctggtcttggactcctgactcaaatgatctgcctgccttggcctcccacagtgctaggattacagacatgagccactgcgcccggccgctaacttaactttcattccacaacttccatcttttatccaaaatctgtgatcattgaatactgtcaccattaatcattggcatttcagtgtttggactttttttttcccccttcgtctttgtggactcttttttaacactcataaagttttaactattgaaaagcaaaggaaacggtgagtgactttttggagtctgtctacccagtggtcacacaaaaggcttactacattacaggaaagataggatgggaaagggatactagaaaattctaagtcaggaacgggggtgtgtattagaaaaattctgatcctggcatgccagatggccttacatctcaatttcttccgtgaaattcctgccaacaaatcatagtgttagaagtacagaagggtccatgggaacagaatttaagggctccgttggtgatacggaactgatcagatggttctcacttgttctcagataacctgtatactgaatatcacaggaagggtatagacgtcatggcagtggttagatattcttgcacctgctgaagctgagaaaattaaagtaattttttttcctgtggaaagtagaaaatcaagcttttgtatgatttcacacagctttctattctctcttttgttgactctgttaagagtaacatttagtggtggaaactatttcaggatcacacccacaacactagagactgtattaatcacttacacacacataggtatagagtaatcttgaaggggctgtaggccaaagataatgcttttttgaagaattagagactagttaccagcacctggtatttgctgtttcctacagagctgactggacagcctagagtctgctgaggaattcagaggatggccagtagaatgttctttccaccccagaatatttggtagggactcagctgctgtggaatgccaaaaaggctttgagtttgtttcactattcttaagattacacgtaattgtttttttgtaagagattatatatattcaagttgaggatggctttgagttagactttccttaatttggaatcacacagcagatgatacatttatttccatctgataagttacttgatgatgtaaaaagacatttgagttaaagatttttgggaaaaaagctgaatgttgagccatttatgttgtgtactggttccctattcacttggacaattttaagtcttaaaacaatcttaaccatgtgcacaagagatttcacatagtatttggtaattaaattaaggaattctagctcaagtcatgctttttgctgaaatagttgtatatatttagtgcggaaacctgtgttttcaaattaatgtaataaaagtttcaataaaatggaagcctttattaccgtgtttcaaatgctatgctaaaccttttccatttgttattatattaacctcctcatacatagccctactaatttttttactttctattttgaaataattacagatttataggaagttgtgaaaaatagtacagagcccatgttcccttcaccaagtttcacctaatggtagtagctcacataacgataatttaatgtcaagaaccaggaaattgtcatcgttgcaatccataagccttttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaaaacatcttggcagtattgaactttctcaatgaaaaatctctaaaattgtgacttgaaaggctttaattttccagtttttctttggttttactcttagcagtaacattttaacttttttttgtctttgaagtaattttcagtgtttcctttacatgttgctttttcttagaaactagttactagcatgaagtagatctttagcctcgttttctaaaaacataaaaaagtaaaactgtggggtttatttcaaaattgagagtcctgtcttttcatatgaggatattttatagtctgttggcttggctatattttagggagtaaacctgtggttagtggtttgttgttggtggtggtaaagttttcttacagtatttttatacctgaataatacctttagactctatagaatagatacttgatcttcaaatctatcctagaataaattgttttatctaaacagctttgtgacctgagaattgggacttagtcccttagttttcccttactggccctttgtagtcactgttttgattttgtgaaagtaacttaactcttagcactgtcaggtattgtacattcctgccaaagcaagaataagaatacataggattgtgttttaattctataattaggtgacttttggctaatttccaggaacttggacttaataaagtactagtgataagtttggaaattttagtgtccttgttctttgaagttattcaccctttactttcttgtttgtttggggtgtttatactactgtccctaaatatagctgaaataaaggaagaaaaataacccctgtaatatcactaccaggatataatttcttttttttttttttttttgagatggagtctcgctctgtcgcccaccatctcggctcactgcaagctctgcctcctgggttcacgccattctcctgcctcatcctcccgagtagctgggactacaggcgcccgccaccacacccggcttattttttgtatttttagtagagacggggtttcactgtgttagccaggatggtcttgatctcctgatcttgtgatccacctgcctcggcctcccaaagtactgggattacaggcatgagccaccgcgcccggcctgatataatttctgttaacagtttgatgtaaatattttttgactttttagtgtttttatatatatatatattttatgtttttcttttatcaatacgcactcttactgtgggaataattttaatgtttttaaagagttgggttttatttgtttattttattttatagaaatggggtctcgccgggtgcgatggctcacgcctgtaatcccagtactttgggaggccaaggcaggagcatcacctgaggtcgggagttcgagaccagcctgaccaacatggataaaccgcctctctactaaaaatacaaaattagccgggcgtggtggcacgtgcctgtaattccagctacttgggaggctgaggcaggagaatcacttgaacccggccggtggaggttgcagtgagcaaagattgtgccattgcactccatcctgggcagcaagagtgaaacttcatctcaaaaaaaataaaaaataaaaaagaaagaaagaaagaaatgggatctcaccattttggctggttttgaacttgtggtctcaagcagtcttcctacctcagcatcccaaagtattgggattacaggtgtgagcccatcctgtttgttgttgttcttttgttgttgttgtttttagatgaagtctccctctgtcacccaggctggagtgcagtggcgctatcttggctcactgcaagccccgccacccaagttcaagcaattttctgcctcagcctcccgagtagctgggattacaggcgcccaccaccatacctggctaatttttgtatttttagtggagacgaggtttcaccatattggccaggctagtcttgagctcctgacctcgtgatccacctgcctcggcctcccaaagtgctgggattacaggtgtgagccactgcgcctggcctgttgttgtttaaataaaagaaatttattctcttacagtcgaggccagaacttagaactggttttcaatctaaattttttttcttctttgggagaagggcatcagaatattgtggatatacttttttgacttaaaaaaaaaggttttactgggctgggcatggtggctcacctgggattaactgcctgtaaccttggcactttgggaggctgaggcaggtggatcgcttgagtccaggagttcaagagcagcttgggtgacatggtgaaactccgtctctaccaaaaaaaaaaaattagccaggcatggtgatggcgtgcccttgaagtcccagctacttgggaggcttagctgggaggatcgcttgagaccaagaggcagaggttgcagtgagctaagttcatgccactgcactccagcctgggtgacagagcgagacctcgtctgaaaaatttttttttttttttactaatatgacaaacatcttttcatttcaaatatatttctataccatttttaatatctcattgcctttagaatgaccttgtattcatagtacatatgtatgtgatattccatttatttattttttttcttttgtctttttttggttatattccattgatttaatgtaccttaatttatcttaccaatttcttgttgaccattttgtttccagtcttttgtttttttaccagacatggattaagctgagcctttgccccagacgacattatttcttttttatcagcaaaatatgcgtgtaatgaaattagaattaaaaggcaaaaaaggttatcctttatttttctacttatttttattgagatagtaattcacataccataaatttaacccttttaaagtgtacagttcagtggttttcatatattagaaggttgtacaaccatcgcaactaattccagaacattttcatcaccccagaaagaaactctgaacccattatcactccccactccctcacacaccctaaccctggcagtcacatatagactctctgtctctgtggatttgtttactctggacctttcatataagtggaatcataacagtttgtggccttttgtgcttggcttctcaaacttatctgtttccaaaggttatctgtgtcgtagcatgtgtcagtacttcattcctttttatggctgaatattttattgcatgtatatgccacattttgtttatccattcacctgtagaaggacatttaggttgtttccattttttggctgttatgaatattactgctgtagacgttcatgtacaagtttttatgtgaacgtgttttcatttttcttgggtatatacttaagtgaggaattcctgggtcttaagttaactctctgtttaacattttgaggaactgccaaattattttttaaagtggctgtgacattttatattctaccagcagtgaatgaaatttccaatttctccacatacttgacagcacttttttttttttttttttttgaggtgaagtcttgctttattgcccaggctggagtgcagtagcatgatcttggctcactgcaacctccacctcccaggttcaagcaattcttgtatctctcagcctcccgagtagctgggattacaggcgcatgtcaccatgcctggctaatttttgtattttttatagagacagggttttgccatgttggtcaggctggtcttgaactcctgatttcaagtgatccacctgccttagcctcccagagttctgggattacaggcgtgagccactgcacccagtctgcactttctttattatctgtcttctttattatagccaatctagtgggtatgaagtaagtgtgtcatttgtgattttgattgttagtggtgactaaaaatgttgaatatctttacatgagcttgttggccatgtgcacatctttgttggagaaatatctattcaaatcttttgactattttaaaattgggttatttatctttttattgttgagctataggagttctttattttattttactgagacagggtcttgctctgtcacctaggctggagtgtagtgatgccatcttgactcactgcaacctctgcccccaccccaggctcaagtgatcctcccacctcagtcagcatcccacagctgggaccacaggcgcatgccaccatgcctggctaattttttttttttttttttttttgtattttagtatagacagagtctcaccttattgcccaggctggtctcaaactcctgagctgaagcaatccgcccatctcagcttcccaaagtgctggaattagaggcatgagccactgtgcctggcctattttattttaaagatgaggcctcactttgtcacccaggttggagtgcagtggcgtgatcatagttcactgccattttgccctcctgggctcaaacagtactcacgactcatcttcctgagtagctaggactgcaggcatgtcgctagcatgcccagctaaaacagttctttatattctagatcggggtgtccaatcttttgacttccctgggccacattagaagaagaagaattgtcttgggccacacataaaatacactaacagtaatgacagctgatgagctaaaaaaagaattaccaaaacatctcataatgttttaagaaagtttacaagtttatgttgggccacattcaaagccatcgtgggcctctggccgtgggttggatgagcttgttctaaatgctagacccttatcagatggatggtttgtagatatttatcgcatgctgtgggttttttttttttactttcttttaggtttttttttttcttaaataattaaactgattaaaagctttaatcttttcattttcttgataatgtcttttaaagcacaaagttttgtttcaatgatgtctaatttgtctatttttttttctttggttgcttgtcatacgtaagaaactgttgctaaatccagaatgctgaagatttacttgtgaactttgtttccttctatgagttttatagttttagctcttgtatttaggtctttgatacattttgaggtttttttgttgttgttgagacagtcttgctctgtcgcccaggctggagtgcagtggtgtgatcttggcttactgcaccctctgcctcctcggttcaagcaattctcatgcttcagcacccgagtagctcggattacaggcgtgcaccaccaagcctggctaatttttgtatttttagtaaagagggggcttcaccatgtttgtcaggttggtcttgaactcctgggctcaagcaatcctctcatctcggcctccccaagtgctgggattacaggcatgagccaccacgcccagcctgttttgagttcatttttaaaatatggtgtgaggtagaggtcccatttcattcctttgcctgtgggtatccagttgtcccagaaccatttgttgaaatgactcttgtttcctcattgagcaatgtcgtgagaccctatctccataaaaaataattaaaaaaaaaaaagaatgcagaaggaaacagttttgccaattttgtagtatttactgacaatttgcatatgtctttacattctttagctatttatttttcttttgaattactgcctttgttcatttttcttttggagttgtttgtctttttcttattaatttgtaagagattttgcaaatatatacaatttcttttctcttttttttgagatggagttttgctcttcttgcccaggctggagtgcagtggcatgatcttggcttactgcagcctctgcctcctggtttcaagagattcttctgcctcagcttcctgagtagctgggattacaggtgcccaccaccacacccagctaattttttttttttttttttgtatttttagtagagactcggtttcatcatgttggccagactggtctcaaactcctcacctcagttgatccacccaccttggcctcccaaagtgctgggattacagttgtgagccaccgtgcctggacctcccacattattttgaaacaaattccatatcacataatttcttttttttgagacagagtctcgctctgtcacccaggctggaatgctgtggcgtgacctgtgcttactgtaccttctgcctcctaggttcaagcgattctcctgcctcagtctcctgagtagctgggattacaggcacgcaccaccacacctggctagtttttgtatttttagtagagatggggtttcaacatgttggccaggctggtcttgaactcctggcctcaggtggtccgtccacttcggcctcccaaagtgctgggattacaggcttgagccactgcacccagccaatatcatataatttcatataaatagttctttgtgtatctttagataaggacttaaaagaaggcataatcgtaacaccattattaatacctaaaagaagtgagcaataaataattcatttgccgtatcaaatatccaatgttcatatttcctccattgtcccataataatttttaaaagtttgctcaaatcaaaatccaaacaagattatttcaaagcattgtttgaggtacattttaaatcttaatttatagatttctctgctgtctcttttcccccatatttatttgttgaagaaaccaagcgttgtttcctgtggactttcctactctctggattttgctggttatattcctctggtatcagtttactatgatccctttttcccctgtattttctgtaaatttgtaactagatctagagatttgtttagattttgtgggttttttttttttttttttttttttttgcaaaaatgcatcataaatggtggtgtgtacatctctcagaagacacatatcttaatgtctttttgtggtattagttattaatgattactgcctatatttattaattcattatttggattgtaagtttatgatagtctcttgatgctttttctgttgttagctggaatgcttctaaaaggagaaggctttcctcttcaagctacttggttgtcttgagggtttgcttcttatagggaaagcaggctaagggtgaaaaaggaaatagtttctaactgggtctgttaatgagctgtcaccccaggcaaagagaagcaaggcaggtcacaggaaagtgaagtgggcttgggatgattggtgccccatgcgtgcatgcatgaagggaagttaatcctccctgtagtgaactctactgggcttttggtcagtagccaagactgtcaaggaagacctttgtcagaagccatacctggcctttgcttttagctgttggtagctgaaggaaaccagaacagacctatgacctgtgaacttctgctcagtagacaaagttctctcagcctaaattcagtaagcaggagtaagatgcttgctttcccttgaagtgaaacgtgaattatatgtttcttcaacttgtgctaatattctttttttttttgagatggagtctcacactgtctcccaggctggagtgcagtggtgcaatctccgctcactgcaacctcagcctcccgagtagctgggattacaggcgcctgccaccacgcctggctaattttttgtatttttagcagagatggggtttcactatgttggccaggctggacttgaactcctgacctcacgatctgcctgcctcggtctcccaaagtgctgggattacaggcgtgagccaccacacctgggcaacttgtgctaatattcttaaccttcatgtgaatcattcctgccctcaggctagcataacccatacagccttccttataggaagatttcctactgggagtgaatttgtccagtgattcccccaagatatcccccaatcaaatattttaaaagtcatcatttacatgtaaaaactatgtaacaagcatggtagcagcagcgttaaagaaatggcagtatggcccctgtaagggaaggctccagaagatgagccgcactcagcctctaggtcacagctaccttaggagtttgcagttgttcctggggaagtcagtagacaaagctatctctcaggcctgggcaagatagggattttttttttttctttgagatggagtctcaccctgtcatccaggctggagtgcagcagcatgatctcggttcaccacaacctccacctcctgggttcaagtgattttactgcctcagcctcctgagtagctgggactacaggtgcgggccatcatgcctggctcatttttgtatttttagtagagatggggtttcaccatgttggctaggctagtctcaaactcctgacctcaggtgatccacctgcctcccagagtgctgggattataggcatgagccactgtgcccagtgtttttttttttttaattgtagtgacaggatctcactttgtttcctgggctattcccaaactccaggcctcaagccgtcctcctaccttagcctcccagagtgctggggttacaggtttgacccactgtgcctagtctcagaattcatgtttttaaaagtcactctgtgccaggctcatgcctgtaatcctaatactttgggaggctgaggcaggagggttgcttgagcccaggagtttgagaccagcctggaaaccatagcaaaatcctaactctacaaaaaatacaaaaaatagccaggtgtggtggcatgcacctgtagtcccggttacttgggaggctgaagtgcaaggatcgcttgagcctaggaagttgaggctgcagtgagctgtgatcatgccactgcacaacagcctgggcaacagagtgagaagtaactctggctgtggtggggaaagtggattagtggagaatggaagctgggaaacatggtggttcttgctaagtcagtatcaagggatcacagatgagggggctatttcgtcctaataagggccttggtctcccagatagtcatggatttttctatttagaagctccttctcagtttttcttgcccaaggcatatacggttgatatttgtacaacacaggctggatctgtatgggtccacttatatgtggattttttttcaaccaaacttggattaaaaatatagttgtaggccaggcacagtgacttatgcctgtaagcctagcactttgggagcccaaggcaggcggatcagctgaggtcaggagtttgagaccagcctggccaatgtggtgaaaccatgtgcctactaaaaatacaaaaaatagctgggtgtggtggtgtgcacttgtaatcccagctactcaggaggctgaagccagagaattgcttgaacccgggaggtggaggttgcagtgagctaacgcagcagaggttgcagtgagctaacgcagcagaggttgcagtgagccaacggggtggaggttgcagtgagccaagattgcaccaccacactctagcctgtgtgacagagcaagactctgtctcaaaaataaataaataaaaatacagtgtaggccaggtatagtggctcatgcctataatcccagaactttgagaggccaaggcaggcagatcagttgaagccaggagtttgagaccaacctggctaacatggtagaaccccacctctactaaacagaagtacagaaattaaccaggcataggtggtgcatgcctgtaatcccagctgcttgctaaactgaggcaggagaattgggaggcagaggttgcagtgagctacgattgtgccactggactccagactgggtgacagagcgagactctgtctccaagagaaaaaaaaaaattgtacttacaggacatgaaacccacctgtacggtgtgctgactgggagactggagtatgcatagttcttggtaaacaaggggattcctgaaaccaatcccctgagtatatggagggttgactatatattttaatagaatttattacttttttttttttttttagcagttttaggtttatggaaaaattgagcaggagtacatagtttctctatctccctcacatttccccattactagcatcttgaaatagtgtggtacatttgttacaactgaagagccaaatattgatacattactgttaactaaggtccgtaatttactttagagttcactcttggtgttgcagtttctatgagtgttggcaaatatatcatgacatgtatctagcattatagtatcatattgagtagtttcactgccctaaaaatcccctttgttccaccttttcatccctccatctacctgaacccctgataaccactgatccttttacagtctctatagttttaccttttacagaatgtcatatagttggaatcatacagattggcttctttccatgttccttcctggcttgatagctcttttcttttttttgagatggagtctcgctctcgcccaggctggagtgcagtggcgcaatcttggctcactgcaaactctccgcctcctgggttcaagcaattctcctgtctcagcctcccaagtagcttggactacaggcgcatacctcccctgcctggctaatgtttgtatttttggtaaaggtggggttttaccatattggtcaggctggtctcaaacacctgtcctcaggtgatccacccacctcggcctcccaaagtgctgggattacaggcgtgagccaccctgccctgccagctcttttttttgtactgctgaataatactccattgtataggtgtatgagtttatctattcaccttctgaaggacattttggttgctcctaagttttggcaattatgcatgaagttactataaacatctgtgtgtaggtttttgtgtggtcatgtttttagctcatttggataaataccaaggagcacgattgttggatcgtatggtaagagtatgtttagttttgtaagaaactgccaaactgtctttcagggtgactgtaccattttgcattcccaccagcaatgaatcaagttcctgtcgctccacatcctcgttagcatttggtgttgtcagtgttttggcttttcaccattctaatagatatgtagtgatatcttgtcttactttgcagttctctaatgacgtatgatgttgagcatcttttcatctgcttatttgttgttgttgttgttgtgttgttcattgaaatggaatctcgctctattgcccaggctggagtgcaatggtacaatcttggctcactgcaacctctgcctcctgggttcaagtgattctcctgcctcagctccccaggtagctgggattacaggcgcccgccaccatgcccggctagtttttgtatttttagtagagacaggatttcaccatgttggccaggctggtcttgaactcctgaccttaggtgatctgcccgcctcggcctcccaaagtgctgggattacaggcgtgagccactgcgcctggctttcatctgcttatttgatatgtgtatatgttatttggcaaagtatctgttctgatcttttgcccattttttaatcagattgttcttttattgcttctggggttctttttgtttgctttttttgagacagagtcttgctctgtcgcccagtctggaatgcagtggcatgatctcagctcactgcgacctctgcttcctgggttcaagtgattcttgtgccttagcctcccaaatagctgggattacaagcatgtgccactgcacctggctaatttttgtatttatagtagggacagggttttgccatgttggccaggctggtcttggactcctggtcttcagtgatccacccacctttgcctcccaaagtaatgagattacaggcgtgagccaccatgcccggcttattgttaagttttaagagttctttgtatatgtgtattttttgattcttttaaaattaatacttaataaaataattgtacatatttatgggatgcatgtgatattttgatacatgcatacaatgtggatcaaatcaaggtaattagagtattacctcaaacatttgtcatttctttatgttgggaacatttcaaaatgtctagctattttgaaatatacaataaattattatctataagtcacctcattgtgctgtcaaacattagaacttattctttctacctggctttattttttttaccccttaaccaaccattcttcatcagctccccgtctcccctactctttttttttttttttttttttgatacggagtcgctctgttacccaggctagagtacagtggcacaatctcgactcactgcagcttccgcctcccaggtttaagcaattctctgcctcagcctcccgagtagctgggattacaggcgaatgctaccacacccgactaatttttatatttttagtagagatggggtttcaccatcttagccagactggtcttgaactcttgacctcctgatccacccgcctcagcctcccaaagtgccgggattacaggggtgagccaccatgcctggcccctcttactcttttcttagcctctggtatctatcattctactctctacttctatgagatcaacttttttttagctcccacatatgagtaagaacatgtaatatttctctttctgggtctggcttctttgtatattttggataataagtcttttattagatacgtgttttgcaaatattttttccgagtccgtgacttatcttttcattctcttaaatagtgtcttttgcagagcacacattatacattttagtgcagtccagtttaccaattctttctttgatggattttgcttttggtattgtgtctagaaagtcttcgccaaaccacagtcatctagagttccccttatattatcttacaggagttttatagtttttgttttacatttaggtctgtgatctattttaagttaatttttatgtgaaagatataagatctatgtctggattctctctttttttgagatggagtctcgctttgtcgccaggctgaagtgcagtggcgcgatctcggctcactgcaacctctgactccctggttcaagggattctcctgcctcagcctcccgagtagcacatgacaccacgcccagctaatttttgtattttgagtagagacggggttgcaccatgttggccaggatggtcttgatctcttgacctcgtgatccgcccgcctcagcctcccaaagtgctgagattacaggcatgagccaccacgtccggccagtttttttgttttatttatttatttatttgaaacagggtcttgttctgttgcccaggctgcagtatagtgacaccatcaaggcttcgttgcagccttgacctcctagggtcaagttatcttcttgcttcagcctcctgagtagctgggactacaggtgagcaccactctgaccaggtactttttaaatttattttagagacagggttttaccatgttgcccaggctggtcttgaactcctgggctgaaatgcccctcctaccttggcctcccaaagtgttgggattacagacatgaggcactcagcccagccaatataattcttttttttttttttgagacagtcttactctgttgcccaggctggagtgcagtggcatgatcacagctcactgcaacctctgcctcctggactcaagctgtcctcccacctcagcctcccaagcagctgggattatgggtgcccatgaccacacccagctaagtttttaaatttttttagagattgaatctttctttttctcagcctggtctcaaactcctgagctcatatgatctgcccgcctccgtctcccaaagtgctgcgattacaggcatgaaccactacgcccagcctacaatttatttgtaatccaagttttattgaaaaaaaaatccacatataagtggacatatgtagatccaacctgtgttgttccagtgtcaaccatatataccaataattcttttttttttttttttttttttttttttttgagatggagtcttgctctgtcgcccaggctggagtgcagcggtgcaatctcatctcactgcaacctctgcctcccgggttcaagtaattctcctgcctcagcctcctgagcagctgggactacaggcatgcaccaccacgcccagataatttttgtatttttagtagagatggggtttcaccatattggccaggctggtctcaaactcctgacctcaagtgatccacccgccttggcctcccaaagtgttgggattacaggagtgagccactgtgcctggcctataattctttacgtatattgttagattcagtttgctagtattttatttagcatttgtgtatctgtgttcatgagaggtattgttctgtagttttctttggtttcttttctgtctggtttagggtaatgctggcctcatagaataggttaggaaatatttcctctgcttctgtttctgaaagagaattgaggtaatatctatttttttttttttgagatggaatcttgctctgtcgcctaggctggagtgtagtggcgcaatcttggttcactgcaacctctgcctcccaggttcaagtgattctcctgcctcagtctcctgagtagctagaattacaggcatgcaccaccatgcctggctaatttttgtatttttagtagagatggggtttcactatgtgggccaggctggtcttgaacttctgatctcaggtgatccacctgtcttgtcctcccaatgtgctgggattacaggcgtgagtcactgtgcctggcccgagataatatctaatttaacagtttggtagaattcaccagtgaacccatctgggcctggtgccttttgctttagaaggttattgattattgattcaatttccttaatagataaaggtgcattgagattgtcttttcttcttgggtaagttttaatacattgtgtctttcaagaaattgttccatttcatctaggttatcaaatttgtgggattagagtccttcataatatttctttgttttgcttttggtgtccataggttcagaagtgatggccctttttcattttttctattagtaatttgtgtctttgcccttttttttctttgttaatctggctagaagcttatcaattttgttgatcttttcaaagaaccagtttttggtttcactgatttttctctattaattttgttttcaatttaattgatttctgctctaattggttttcttctgctcactttggatttaattttttttagtttttctagaaaactaagtttttaagtgaaaactgagattattgatttttagatcttttttctaatgtttacagttaacactgtacaatttcctgtaagcactgctttctctatatcttacaaattttgatgtcatattttcattttcatttagttagaaatatctcttgagacttctttgacccatctgttatttagaagtgtattgtttaatctccaagtatgtattttgggatttttctggctatctttctgctgttgatttctagtttaattacatgtggtctgagagcataccttgtatgctttctattcttttcaatttgttaaggtgctctttgtggctcaaggtggtctactttttttttttttttttttttaaagaaaagctggccaggtgcagtggcttatgcctgtactccagcactttgggaggcgtaagtgggaggatcacttgaggtcaggagtttgagaccagcctgggcaacatatagagacttcacttgcacaacaaatttttaaaatattagttgggtatggtggcatatacctgtatatggctgaagtgggaggattgcttgagccctggaggttgaggctacatgagccatgatcgcaccactgtactccagcctgggcaacagagtgaaattttgttctctcttgaaaagaaaaaaaaagttgatgacataaagttcattcatcttttttgtatgtgacttcaaaataactactgatggttaaaaaaaaaatcagaatgatgcaacccaagtgtccatcaatggatgaatagataatatgtggtgtatgaatacaatgggctactattattcagcctttaaaaataagaaaatgctgacactgctgtaacatggatgaacgttcagatcattatgctaaatgagaaaagccagacacaaaaggacaaatattgcatgattgcacttatatgaggtatctggaatataagagtcatagaaacagtaattcagtaattagaataatgcttgccagggcctgtggggaggagggaatgaggaattcatgtttaatgggtacagagtttcatttggaaaagattaaaaagttatggaggtggatggtggtgaggattgcacaacagtgtgaatgtacttaataccactgaactgtacacctaaaaatgattaaaatggtacattttatgttacatatgttttacaacaatttttacagatggaaaaaaattataaaaaacatcaggatggtgttgacagtgaaaaggttaaagagttactttaaaaatttactttattccagccgggtgcggtggctcacacctgtaatcccagcactttgggagaccgaggcgggtggatcacctgaggtcaggagtttgagaccagcctgaccaacatggagaaaccccgtctctactaaaaatacaaaattagccaggtgtggtggcgcatgcctgtaatcccagctacttgggaggctgaggcaggagaatcgcttgaacccgggtggtggaggttgcagtgagccgagatcttgccattgcactccagcctgggcaacaaagcgcaactccgtctcaaaagaaaattttttttttttactttatcccaaatgtttatatttactttggggcttatgtgaccagtttaattttcatttgtaattgacttgatagaacacactaatgttcagttaagatttcttatggtgtggtgaggagtaggatttttatgtaaataagcccaaaattgtatatatgaggttaatctgatatttgcagaagatattcatgcattactgtaaggaccactctgcttattcatttgaccgatttgttacaacatggttagaaatcatcaaggtgtttgagatcaaaggatcttcagaggtgatttactccaatccttttttaaaaaattaataacttgagcctcagagaagttaagtgacattaccaagttctgctgttagtatagtgactttatctttacctgaatccagggtttcttagccctagtctgtaatgtgtcctagtgtgcctctagaatctggtcctgtcagcccaagtctgttaaatcaaataaaaccagggcttggtgcttcaccttgtcttctgccataccgttgggtttcctgtggaccatgcagataatgatgatgggctcagtgggcttgatagtgataactcctaaagcagctccttctaagtgcggttctcaatctgaggaagttaaaaaaaaaattagtgactagaacccacttctcaggtactctgataaaatacatttgtaggggagtgatagttttcactttctttttttctttttcttttttttttgagatggcgtctcgctcttttgcccaggctggagtgcaatggtgcgatctcagcttactgcaacctctgcctcccagtttcaagtgattcttctgccttagcttcctgagtagctgagattacaggtgtgtgccaccatgcctggctaatttttgtatttttattagagacgggatttcaccatggttggtcaggttggtctcgaactcctaaccttgtgatctgcctgcctcagcctcccagagtgctgggattacaggcatgagccactgtgcccagccttcacatattttttgaaataataggccagttgcggtggttcatgcctgtaatctcacactttgggaggccgaggtgggcagatcacttgaggccaggagttcaaggccaccctggccaacatggcgaaaccctgtttctactaaaaatacaaaaaaattagccgggtatgatggcatgtgcctgtggtcccagctactctggaagttgaggcatgagaatcgctttaacttaggaggtggaggttgcagtgaggcaagatcgtgcccctgcactccagcctgggtgacagagcgagactccatctcaaaaaaaaaaaaaaaaatcgtatgcagtaaaggttgaaaactgctgcccaaaggcgctattaaactataggttcccaaacctggccaattgtcaaaatccctcaagaaggggcagtggggtctaagggaccccattgctgtagaggagattagtagtccaagagtgagatgaactgttggaagtcctcaaacttccaaactattaaaatagaatagttttgcttccttaaaatagaatagttttcttcctcactgatttttctgtattgattagaaccataacaagtgaattaaacaactacaaaatagttatgtgggccacagacattattgtaatgaagtgaagtttggctcaggccttgtaacacaattgctttttggattaaaagtaaaaatattaaattgtgaaattatgtgtaagttttaaaaaattggtcttgtacaaaagtgttgggtttttctttgtttttaactggatttgtttttaagcaagacagaatatttatattgttggagagtcacaaaggaggtgtgtttgtggatttaaatgtggagacagtgtgccttgaaatgccctttatcagtctgattcaagccacctgcaatcatggatttgaacttttttttttttttcccctgagatagggttgcctaggctggggtgcagtggtgtgatcttggctcactgcaacctctggctcagcctcttggagtacctgggactataggcacacaacatcatatccagctattgtatttttttttttttttttttttatagagacagagtttcaccatgttgtccaggctggtcttgaactcctgagctcaagcaactcacctgcctcggccttccagagtgctgagattataggtgtgagccaccatgcccagccttcactttatttaaaaaccatagtttttaaaagccacattcctactgatgaacacagaggttgtttccagtgttttcatttgcagggctgtagtgattgtttttgcacatgcctctttatgtacatgtgctgtgtcttctgggacagagagtggacattttaagtgttttattggtcctgctaaattgtctttcagccaaactgctgcagaggtgatggagatgaggtgggtactcaggagaattatgctcagtgcttgtgtgctagtcactgacctggaaacattttattaaaaatgctagattaggttagtgatgtaaataccaggtgatagtaaccagaataattgtgtcaaaacatcaagaatcatcaagagatgccaggcatggtggctcatgcctgtaatctcagccctttagtaggaggccgaggtgggcagattgcttgagctcaggagttcaagaccagcctaggcaacatggtgaaaccctgtctctaccaaaaatacaaaaatttgctggatgcagtggtacgtgcatgtggtcccagctactcagtaggctgaggcgggaggatcgcttgagcctgggaggcagaggttgcagtgagccaagactacactacagcccgggcaacagagtgaaaccctgccataaaaaaaggagaaaaagaatcatcaagagaaaacttaatttgatgtgctctgcgttttctttggtgcttcatgtcagtgttagaaactataggttgtatatttattaatttttctcctacatttgttcaacttgactaaaatattaactccaaatgcctagaatttcaaaatacctcttcgttataaagtatcaactatttcttagtccccttaagctgatagtattgtgtcattgtaaaagatcccttgtgaaaaataatttttgtcaacatgaaaggtcttaatgtgtctcctagtttacattttacatggtcttttccatgtatttatatagttgacatatatagctttttttgtaaatacactttcctatgtgaacatgccaaggtttacttaagcattctcttattcttggacatctaaattgcttcttattttctattgtaaataaagtgctagaagcttctttcctgaaaagttatttacttttcacctagtatttccatctgtgttcctcaaaataagattgctgagattcatgtatgttgccagaaagattgtgaggtttaacagtgaatgaggaaaacttttaacactcaaggtctaccaagtacagcaagttttattttacctttttttttttttttttttttttttttttttgagttaggccaagttgcctaggctgggctcaagcaatccttctgcctcagcctccggagtagctgggattataggtgtgcagcaccacacccggctttcttgtattttttttttatttttatttatttatttatttttgagatggagtttcactcttgtcacccaggctggagtgcaatggcccaatctcgactcaccgcaacctctgcctcccaggttcaagcgattcttctgcctcagcctcccaagtagctgggattacaggcatgtgccaccacacccggctaatttttctatttttagtagagacggggttcctccatgttggtcaggctggtctcaaactcccgacctcaggtgatccacccacctgagcctcccaaagtgctgggattacaggtgtgagccaccgtgcctggctgctttcttgtattttatcttgctgtagcggttgtgggatttttgcctggtgtgttcattggagtgtgtgtgtgtgttttgagatgtatgactgtgttggttgtgttgtcatactttgaaggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtacacagatgtgcctgctaataacttctgtagacagcaaagtttaagagaaattaggtggtaaatgcaacatatgtatctaaataaatttggtctgagggatttgataagatgaaacagtacatagtccagaaaatttttatactcaaagaattatagaaaatatctgaaatgttttcagttttgtgcatatccagaaaatgtcatcctgtgatctgctggttggcagcccaatggcagtattagatgtattgtttttattttgttttgtttgctatttatttggttaagagagttacctaattaggagtgtgaaaaaaaagatttattatagtagtgggcttttgtttgacttaaaacatttttgttgttaccacagtatgagtgccttgtttgtgaaatttgtttaccgggaagccatatacttagagtagcttttagtttatcattatcatcatcatcatcatcatcatcatcatcatcatcatctccttcatcatgaaaggaagaagctaccaatgttgctttattctgcaaaaaatacaatagatgcttgttgaaagtatggagtgaaatcttaaatatgtctgttaaaaagagtacaactggccaggggtagtgcctcatgcctgtaatcccagcactttgggaggccaaggcgggcagatcgcttgagccaggagtttgagaccagcctgggcaacatggtgaaatcctgtctctacaaaaaaaaaaaaaatagacaaaaattagctgggtgtgatggcatgcagctgtagtcccagctacagtggggctgaggcagggggattgcttgagcccaggaagtaaaggctgcagtgagctatggttgtgccactgcattccagtgtgggtaacagaacgaaaccctgtctcaaaaaaaaaaaaatagtacaactttaagcaggatgtgggcacatgcctgtagtctcagctacttgggaggctaagtcaggagagtcacttgagcccaggagcttgatgctgcagtgagatgtgattgtgccactgccttccagcctggggatgatagcaagaccccatctctaaaaaaaaaacaaaaaacaaaaaaaaaacagagtacaacaacctttggtaaacttggaatataaaggtgtttccttaacctgttaaagagctgataaagagtggtactttcaaaccagtacacattatgtgaaacactagagacacttcccatttgttaaaagaaaaaccttagccaaattaaatttaagttttttttggagacagagtcttgctttgtcacccaggctggagtgcagtggtgcaagcacagctcactgcaacctccgccttctgggttcaagtgattttcctgcctcagcctcctgcgtagctgggactacaggtgtgcaccaccacgcctgggtgatttttgtattttttgtagacatggggttttgccatgttgcccagtctggtcttgaactcctgggctcaagcaatctgcctgcctgggcctctgaaagtgctgggattacaggcgtgagccaccatgccatttaatggtttaattgagcaaagaatgatttgcaaattgggcagcctcccgagccagagtaggttcagagactccagcacagccatgtcgtggaaaaagatttatgaatggaaagaggaaagtgatgtaccgaaaacggaagtgaggtacagaaacagccggattggttacagctctgaatttgccttatttgaacacaagttgaggtttgtacagttggccacctttgattggccaaaactcggtgattggcacaagagcaggttatagtctgtttacatctccattttggttatagttcattatggacagaaaaacctgtaggtcaaacttaaaatatgtaaggagacagttttaggctaaacttgatttaacacattaaatccgtaacaagacaggatgcctgccctcaccatgttatttgatcttattttagtaattctagccaatgtagtagggcaagaaaactgcctgcttggctacaaaataaacacacaaaagtcagtatctgtaatatgtgacagaaaatataattaaaaaaaaaaaaaaaagccgggcacagtggcccatgactgtaatcctagcactttgggaggccaacgtgggtggatctcttgagctcaggagttcaagaccatcctaggcaacatggcaaaaccccgtctctacaaaaaatacaaaaaaattagccacgtgtggtggtgagctcctatagtcccagctactttggaggctgaggttggaggatcatttgaacctgagaagcacaggttatagtgagctgagatcacgccactgcactccagcctgggtgacaaagtgagactctgtctaaaaaaaaaaaaaaaagaagaaaaggaaaggaaagtaaaagaaaaaataatttcacttactagagcatcaaatccctaagataatttagagcaaagccagaaaagtgaagaaaatataaaaatctttacagtgggttgcattttaaaaaaaaacttgaagatatcagatcaactcactaatgtattaattaatataatttaaattaaaatcccactgatttttttgtggggagggtgggagagtcatttgttaaaatgattctaaagagcatctggaagaataagcaggcaagaatagccaagaacattttgaaaactaaagatgagtttggaagacgattggttttgtactgtcaactacttatagattttacatgaattttaaagggtaatctgagccctcgaatagacagaaatagccatagatctgaaagaacacttaagacctgatccagctatccatgagagtatatataatcaaagtctttgtgtgtgaatcaggagtctttcaggtgcaaggtaaataaactcataattgcttacgcaaaggtggtatttgctttagtgactccagagaaagctcaagtgcctatctctcccctgactttgattctttttggggttggctccattctctcctgttgctaatggcttcctttgtgcagccagaggaaaggaggtgtggttttttgatacttccaggcttctatttttatagcttgagatcaaagagggaagtgaccttccttagagtcagtgtgtaaagtcctaaggaagataccacgtggggtgctggggccatgtgcccatccctggcccatgaccatggggatgctacactaactgggggccacgcatggctgttcctgccctgaactgccagctggctttgcagtgcagcctcaccagaatcacatggaatagtagggatatgaattgtttcccaaagaaagtgtgtggggtggtagaattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttctttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccctctcctcagcctcctgggtaactgggattacagctatacaccactgtgcccagtgtgacaattatgaataaggctgctgtaaacttctgtgtaggtttttttgtgtgtggacattggttttcagttcattatggtaaataccaaggagtgcagttgctggattgtatggtaaaagtatgtttagtttgctaaggaactgccagctgggtgtggtggctcatgcctgtaatcctagcataatgggaggctgagacaggaggatcccttgaagccaggagttcgagactagcctgggcaacatagtgagacctcatctctacaaaaaatttaaaaattagctgggcgtggtcttatgtgcctatagtcctaactgcttgggagactgaggtgggaggatcacttgagcccaggagctggaggtggcagtaaactgtgatcataccactgcactgctgcctgggtgacaaagcaagaccctgacttaaaaaaaaaaagagaaaagaaaaaaagatgagtcagagggtaaggaagcaaaaataagtaaataaataaatagaagagaaaagaaaaaagaaaaaactgtctttcaaagtggctgcgccattttgcattcctaccagcaatgaatgagagtctgttgttgcacatcctcaccagcatttggtgttgtcagtgttctggattttgaatattctattaggtatataatgctgtctcacttgttttaatcaatgatatatgacattgagcatctttttaatatgtttacttctcatctatgtatcttctttagtgaggcctttgtttaggtcttctgcccattttaaaaaatgggttcattttcttattgttgaatatcatgagttctttgtctattttgaatacctgccttttgctttatttttgtgttttttattttttttttttattgagacaagttctcactctgttgcccaggctagagtgcagtggcatgaacatggctcactgcagcctcaacttctcccagcctcaagcaatcctcttgcctcagccttccgagtagctgggactataggcacacaccaccatgccctgctaatttaaaagagtttttttttgtagaggtgggatctcgccatgttacccaggtggtcttgaactcctggcctcaggcaatcttccagccctcagcctcccaaagtgctgattataggcctgagccacttagcctagctcagaatttattttttatttgttaattttgaaaaaatataggacctcataaaagtcagtctacatttgtacacattatgtttttggtgaatatgtaa

SEQ ID NO: 100 - DNA, 1625 bp, Homo sapiens
gcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggc

SEQ ID NO: 101 - DNA, 3091 bp, Homo sapiens
ctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatg

SEQ ID NO: 102 - DNA, 1343 bp, Homo sapiens
ccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatga

SEQ ID NO: 103 - DNA, 6555 bp, Homo sapiens
tgtgaaacttaactgcgtattgttacttataaacacttcaattggatgaactcaaactgattattgaatctaaagacaacatcaatatggtgatcagcttctaagatggtccagcgatccctacctcatggtagttataccctggcatagtcccctcctgcattatatcagagttgatctgtgtgatcaatagaatatggcagaatagatgctatgccacttcaaatattgcattgtaaatggcactacaggttctatttgcattctgtctctctggctctgtctctcgggctctgtctctctgatcactcattctggggaaagtcatactgtaagaaaccttatggtggagagacccacatggtgagaaactgaggccttccaacaacaacgggggaatagaccctgcagccccagtcaggtcttcagagattgcagtccctgaaccagaatcacccaggctaagccatccccagatcccgaaatctcacaaactatatgagatgataaatatttgctattttaagctacatgaatactttggagacattatgggtttggttccagaccaccacaataaagcaaatagtgcaataaagcaactcatacaatctttttggtttctcagtgcataaaaaagttgggtttacactatactgtggtctattaagtgtgaaatagcattatgcctaaaaaacaaggtacatatttaatttaaaaatgctttatggttaaaaaatggtgaagatcaactgagacttcagtgaatcctaatctttttgctggtggagggttttgtcttgatgttgatgactgctgactgatcagggtggggtgatgattgctaaaggttggagtggctgtgacaatttttaaaaataaaacagtgaagttatccatatcaattgactgttcctttcactaaagatttatctaaagcatgctctctgtctctctctgtctctctttgatcactcactctggggaaagttatactgtttggtagtattgtaaccacagtagaactttttcaaaatgggactcaatcctctgaaaccctgtcaatactttgttaaagaagtttatgtaatattctaaatcctctgttgtcatttcaacaatgttcatggttgttgaccaagagtagattccatgtaaagaaaccactttccataagaagcaactcctcatctatttaaggtttatcaggagattgcagcagttcagtcacaacttcaagctccacttctaattctaattctcttgctatttccaccacatctgcagttgcttcctcaactgaagtcttgaaccccttaaaatcatccatgagggttggcatcaacttcttccaaacttgtgttaatttggatattttgaccttctcccatgaatcactaatgttcttactggcttctagaatagtgaatcctttccagaaggttttcaatttactttgcccagatccatctgaggaatcattgtctatggcagctttagccttctaaaatgtatttctttaataagaccagtaagtcaaaattactccttcatccatgggttacaggatggatattgtgttagcaggtataaaaacaatattaatattcttgtgcatctccatcagagctcctgggtcaccaggtgcattgtcaatgaacagtaatactttaaaaataatctttttgtttgagcagtaagtctcaaaagtgggcttaaaatattcatcatgccatgctgtaaacagatgtgctgtcattcacgctgtttggttccatttctagagcacaggcagagtagatgtagaataattcttaaggaccctaggatttttgagttagtaaatgagtattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttcttaagaataattcttaaggaccctaggatttttgagttagtaaataagtattgtcttcaacttaaagttaccagctgcgttatcccccttacaagagagtcaacctgtcttttgaagctttgaagccaggcattgacttttgctgtctagttacacaagtcctagaaagcatcttcctcaatataaagttgtttcacctacattaaaaatctgttgcttagtatagccactatcatcagtgattttatctagatcttctggataacttgatgcagtttctacatcggcacttgctgcctcaccttgcccttttatgttatgaaaatggcttctttccttaaacctcatgagccacaacctctgctagatgcaaacttttcttctgcagctctctcacctctctcagccttcatagaattgaagagagttacgccttgctctggactaggttttggcttaaggtaatgtcgtggctggtttgatagtctatccaaactactaaaactttcttcatattagtaataagcctattttgttttcttaacatttgtgtattcactggaatagtattttaatttccttcaagaacttttcttttgcattcagaacttggctaactgcttgttgcaagaagcctagctctcagcctgtcttggtttctgacatgccttcttcactatgcttaattatttctagattttgctttaatgctagagatgtacaattcttccttttacttgaacactcagaggccactgtagggttattcattgacctaatttcaatatttttgtgtctttgagaatagggaggcccattgagagggagagagatgaggaaatggcccatgagtggagaagtcagaacacacataccacttatcgatgaagttctcctactcatttgagtgtggttcatggcactccaaaacggttacaatagcaatctcaatgatctcaaagatcactgatgtgccaagtgcagcagcctcccagctacttgggagaccaaggtgggaggtttgcttgagcccaggagttgaagatcagcctgggcaatatagagagactctgtctccacaaaaacataaaatttgctgggtgtggtggcacgcatctgcagtcccagccactcaggaggctgaggtgggaagattgattgagccatgggaaagtcaaggctcagagagccatgatcatgctattgtgttccagcctgggcaacagagcaagaccctgtcaaaaagagagagagagaaagagaaagaaagaaagagagaaagaagaaagaaagaaagaaaaaaagaaagaaagaaagaaagaaaggagaaaggaaggaagaaggaagaaagagagagagagaaaaagaaagagaaggaaagaagaaagaaagaaaaggaaagaagaaagaaagaaggaaggaaggaaagagaaaggaaagaaagaaaaagaaagaaagaaagaaagaaagaaagaaagaaagaaagaaagaaagaaagaaagaaagaaagaaagagtcagggtcagtggctcaggcctataatcctaacaccttgggaggccaaggtgtgcagatcatgaggtcaggagttcaagaccatcctgaccaacatggtgaaaccagcctgcccaacatggtctctactaaaaataaaaaaattagccgggcatggtgggcgtgtgcctgtgatcccagctactcaggaggctgaggcaagggaatcacttgaacccaggaggtagaggttgcagtgagctgagatcacgccactgcactccagcctgggtgacagagcaagactctgtcaaaaaaaaaaaaaaaaaaaaaagaggaagaagaaaggaaggaagaaaagaaggaaggaaggagggaaggaaggacaatgaaaagaaaaaaaagaggaaaataatcactaatcacaaataaccataacagataaaatgataatgggaaagttctaaatataatgagaattaccaaaatgtgacacagagacacaaagtgagcatatggcattgaaaaaatggtgtcaatagacttgctcgacacagggttgccacaaacctttgatttgtttaaaaaaaaaaaaagcaatatctgtaaaatgctataaagtgaagtgaaataaaacaaggtaggcctgtactaaattttggtataatttgttaggcaaccaacagataatcgatgcaaacagttacagcttgaacctggcgagatgccatctcaatagggtttttatgtatgtgttacatggtaactttaaggctggaaaaggaaaaggaaaaagagaaataaactaaataatcagtgtagtaggatcaaagtgtttacttttaggctttcaaatcaaactacacagtgtggactagagtctactgatgcaatttctaaatcattgagactactaatcccaagcagccaataaaataatttgtcagtcaatctgtgaatttgtcagcatctcttttcactcttgttctccccagtcctcagctattttgaaaatcacatctcattggaagttgaaccagaaaaaagaagaacactgaagcttacatatgtgttctgctactctttgtggtttgtggtggaggctagttagactaaatttgaaagttggcaaaattgggcaccataatccttcttcaatcccctctctcttggtgctgagcattcttttttttttttttttttttttggacagagtctagtcctgttgcccaggctggagtacagtggcacaatcttggctcactgcaacctccacctcccaggttcaagtgattctccagcctcaacctccctagtagctgggtttacaggcacccaccagcaggcctgtggtgccgggcattcttatgctgtcttccacctgcctaaacccctcttctatggcatttacccaggactgcctttccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatga

SEQ ID NO: 104 - DNA, 16016 bp, Homo sapiens
tgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttgg

SEQ ID NO: 105 - DNA, 22982 bp, Homo sapiens
gttcttgaatcacaaaacacaaatgtaataaaacaaccccattctggattactgcagtgaaattaatcagaaaattataggagaaagatgtttctgatgttctcaggttgaaggtaggaatcaatctcagaacctttggctaccttcaagaacagcttttcctttttcttcttcttttttttttttttttttttttgagacgaagtctcactcttgtcccccaggctggagcgcgatagcacaatctcagctcactgcaacctctgcctcccgggttcaagcgattctcctgcctcagcctcctgagtagctgggattacaggcgcctgccaccatgcccggctaatttttgtatttttagtagagacgaggtttcaccatgttggccaggatggtctcgaactcctgacctcaggtgatccgcccgcctcagtctcccaaagtgctgggattacaggcatgaaccactgcacccagccatttttcttcttttattattattattaaatattctaaaaaatctatagagggaaaggagggagagaacagctgggcaccagcagacatatttgagttcttacttttattttattgagacaagatctctgctgggtgtggtggctcatgcctgtaatcccagcactttgggaaggcagaggcaggcagatcacttgaggtcaggagttagagaccagcctggccaacatgatgaaacgctgtctctactaaaaatacaaaaattagccacgcatggtggcgcacacctgtaatcctactcgggaggctgagacaggagaattgtttgaacctgggaggtggaggttgcagtgaaccgagactgtgccactgcacccagcctgggcgacagagcgagattctgtctcaaaggaaaaaaagaaaaaagggaattgttaattgagacaaggtctgactgtctcccaggtatagtggcgcaatcacagctcactgcggcctcaacttcctgggctcaagcaatcctcccctctcagcttctccagtagctaaggacacagatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaaaacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtctcctccctgatccaattccaaagccaccacttgggcctcatagcttccacagaacctctctgatgactttaatgctcattttccactacttagctcttttaccattcactgttactaggaaagaatttagtccttaagcacatgttttcctgttagtctttttttaaaaaattaaaaagcctttaagtattctatttatcattaaaattttcattattttacatgttagtaagtgaactcattaatgtttaaaaagaaaatactgtgcttttactacttttatttcctcacaatgcctagctaactgcatgagacagaatagtattcaataaataagttgctatcaaattatcacaagatcattatttgggctaaatgatgtaagttaaattcacattatacaccaaacttcttggaaagtgatttgcatttattataaagagcataaggttggtgacataatgtttttttttaaaaaagcataaggaattccaaaataatttaaacaatagcctatcatttctaagatagacattaaaaactctgattctgcttatatttcttactcatggtaagaaactgtaaagaaatagttttttttttttttttaaacaaccacctcttgatcaaaaaataagtttttaatcagagaaatgggtacattttcctcacccctcctggagaaggagcatgaaagtctgttttttgttgttgttgtttttttcatttttttaaaaatttttttgaggtggagtctcactctgttgcctaggctggagtgcagtggcatgatctccactcactgcaacctcccaggttcaagcaattctcctgcctcagcctctcgagtagctgggattacagatgtgcaccaccatgcctggctaatttttgtacttttagtggagacgaggtttcaccatgttggtcaggctggtctcaaactcctgacctcaggtgagccacccgccttggcctcccaaaatgctgcaattataggtgtgagccaccacacctggcccaaatctggttttaagatgcagaattttgctggttattcccttccacagggtgcagcacagcctggagcagctatctcaacagcaaagttcagaatcaccagtcccccgccaccattattattaaggagcatgtttgaccagaggctcactcccacatctttattcaatactgctgacctagattttgttcttaaaactacacagcagaagcaggcaaactcccctgtagaaacaacagccttcagaataaattttttagcatacttgcaatctactcagagagtctatttcagtaaaactatggaaaatgaaattctaaacaagaagcaatttacataatgcagtagaaaaaatacttaccactaccactggccatccctagagactttgattctcctataaaagtagaatggggaaggacaggggacagttttctatctctgtgaaattgaaggcatttaacagaaaaggcatatggctaaacacttaaagtactaattaaacaagtagcatatctacatatcaaaactagactaattctgtcacatatgatccattccaagtgcaagatagactaatggattttaaataacagtacaaaaagttcattgatatggtttcagattccccattgcaaacaacctttaagaaactaccacttggctaggtgcagtagttcacccctgtaaaccacagcactttgggaggctgaggtgggagaactgcttgagaccaggaatatttttttcatttttggagacagagttttgctcttgctgcccaggctggagtgcaatggtgcaatctcggctcactgtaacctctacctcccgggttcaagcaactctcctgcctcagcctcccaggtagctgggattacaggcagccaccaccacacttggctaattttttgtatttttagtagagacggggttttaccatgctggccaagctggtctcaaactcctgatctcaggtgatccacccacctcggcctcccaaagtcctgggattacagcgcctggccagagcccaggaatttgagatcagcctgggcaacataatgagaccctatctctaccaaaaaaaaaaaaaaaaaaaaaaaaaaaggaagaagaagaagaaaagaaactaccatttgtgaagttttgatgtcaaatcaaatacccatagttacctggaaaaaaaactgtcaaaatattcctcctcctaactacatatttgtgtgaaatggattttcttcatatactgcaacccaaacaacatattgtgacagactgaatgcagaggcagatataaaaatacagctgtgttctattaagacagacattaaaaagatttttaaaagcgaaaccatggctgggctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccctctccccattccctgcagaaagtcaagaaatccaagacaaagttcaggcttcattatgcttttgggatagaagcttagccatgtgagaaatgaaaaaatacacaacacagtatctcattaagagctaaacttaatcataaagacgttaaaatggcataacaataaaaattaagaaaaattaatgctggcaaaggtgcttcacagaaaagaaaggggaaaatgtctgaatgtggtattttcatttactactgacagttttttttaaattaaaaacttttttttctatttatttttagagatggggtctcactttgttgcctaggctggagtgcagtagctattcacaggcataattatagctcactgcagccttgactgagctcctggccccaagtgattctcccacatcagcttcccatgtagcagggactacaggtacatgccactgtgccctgacaatcaccactgtttttgttttttgttttttgcttttttcatgcacacagggataccagttactgttgacattgtaagtaacacatgtgagaacatcttagattattagatcaaacaaaggtgacaaggaaaatacgtgtatattcatatacatacatatcttacagaatgctaaaatagttgtggtaaaatcgtattgattgttgaatctggaaaaatgtataaagttctttcaacttttctataaatttgaaattatttcaaaataagctgggcatggcggctcacacctgtaatcatcgcaatttgggaggtggaggcaggaggatcgcctgagcccaggcattggagaccagcttgggcaatgtagcaagaccccaacctctacaaaaaaaatttaaaaaattagccaggcacggtagtgcacacctgtcgtcccagttactttggaggctgaggtgggaggattgcttgagccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccagatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaacccatctcaattaaaaaaacaaaaataaattaatgatatttgacatccctacaatggttggaagactctgagtttagccctctagcaatatttgaaaacaccaaggcatttgaaggaaatctccagcaggaaggagataactttaagatcacatagcacacttgttttgcttcaaccagaaattctgctggatgtgtctcagagtggccacaggtgaaggatgctaccctgagaccacaatacaggctaagttggcagtagctgagctgtcaactcagaatactgaatagtttcagtattctacctcctacaacacttgatttattatcatactgaatgtacttgttcctataaacacacctctctacacaacttcctataaaaacatgtgtccctggcaaggcgtggtggctcacgcctgtaatctcagcactttgggaggctgaggcaggtggatcacaaggtcaggagatcaagaacagcctgatcaacatggtgaaaccctgtctctactaaaaatacaaaaattagctgggtgtggtggcacacgcctgtaatcccagctaatcaggaggctgaggcagaagaatggcttgaacctgggaggcggaggttgcagtgagccaagatcacgtcactgcactccagcctgggcgagagagcaaaactctgtctcaaaaacaaaaacaaaaacaaaatgtgtccccatgcaacttcctttctcattctccacagtctgttatacatactttcttttccagctcactccatccaaaatatagtattttactttatagaaaatgatattatatgactgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttgg

SEQ ID NO: 106 - DNA, 6401 bp, Homo sapiens
ccaggaaaaaattcacttaagaatgaatatggacacaaacaatttcatagactaccctggaagtggtctccaggatacttctcatcttgacattctatatttaaagctatttggtcactgaaagaaacaaggttgggcacagtagctgtcacctataatcccagcattttgggccaccaaggcaggagaatcgctggagaccaggagttctagactagcctgagcaacaaagtgagaccctgtaaaatatatatatattttacatacatatatatatatatgtatgtgtatatatatataatatatatatatatttttttttttaattagctaggcatggcagctcatgcctgtagtcccagatactcaagaggctgagatgggaggctctcttgagcctaggaggttgaggctacagtgagacaagatcacaccactgcacttcagcctggatggcagagcaagaccctgtcaaaaaagaaagaggctgcatgcggtggctcacacctgtaatcccagcactttgggaggctgagataggaggatcacttgaggccaggagtttgagaccagcctgggcaacacagcaagacctcatctctaaaaagaggaagaggggaagggaggcagggagggagggatattattttccatagccattaccatgatacatatgatactgcctaggtagagctgggactgtagggtggggaaccaatgctgtcctgcacactgagactatgaatgccaagatatcactgccagatccttctgtggatgaggctgggccaagcttgaagaagtcccctcagtggctggagatgcctacagcgttctataaaacaaagccactcctattaaaacttaaagggaagctatttgctttggttctctgagtatatctcttctttcagtccaatgagcagttagtgtctagctttgctctatgtgaaagccaatataatatggagatatttatggatgaaatggtatgctatctaggatttgcttctaaagaaaccaggggaagataagaacagtgaaatcaagattggtcatgagttgtcaacggctgaagttgagggatttgttttctctccaacttacttatttttacatttttgattgaaagacagaacagaaagtcaaagtgaaagatcaggaggtcaaggaatttttcacgtcctgtacaagtcctgggcacgaagctaaactaatcctactcgattcacgtcttgacgagcccacagatagcaaaatctgtggctcacagaatatggaattgacacagggttattttgagaaccatcttacagtccaaaagacatgactttcaaccaaggggaaaaaaaaaagaatttttgtctgtgtgtggaatgtctttcttcacatggacagctcagaggtgggcgaaaatgcagaattgggcagcaagaagtattgtccccaccttggaaggcctgcattcccctttctgtccagcaggccatcgagcccagcatggtttggcatgattcattgctctctaactttggacttaatgtaaaatgtttgttattcttgtaaagcaccctttagcagatagaaaatgattttccttcttgttgttagcttctgtttttgccctttttttcccccaacaaaagacagcagttttagaatgagactgagcctcatcactacaaaaggacttcagctccgattcctcatgccttgcttgggaaagcagcagcagacagagcaggagccatgctggcttctgtcaaacaaaggggttcaggggatcagccagagaaaactggagctaccactcaatctattcctgcctccaagtattcccgcaatgtaggaaagttgacagaaaaggttgagggtagggaactgaatctgagcctttgggcagtcctcttccacagtgactctggacttgacagtgtgacttgcttcagccaatggggataatagcaagcatgacgcaagcaagggttgaaaaatgtgtgtgccctggagcttgtacccttgcttttcttgggaaccctgtggtgtgaccactactatgtaaacaagccagagctagactgttgtgacaagagacacatggccaagccatcccatggccccagctgagactggaccaactaccagacatgtgagtgaggccaccctagatcatccattcccagccaagccactagctgaccacagtgattgaatgaaccagctgagaccagaactgccacgccagtgcacaaaatcataagaaagtataaacatttattatttaagttactgagtttgggtgattggtcacaccaaaagctaacacaagaaaaggtggctaagcagagctaagatgtattgaacattgggagacatatcccctaatggctctttacacaatagtcagtgggactcactattgatgcgactgtatgtcaactgtcattgaaataacctgacatagatccaaaattgaccatactccctaatactcatttcaagacaatgttagttgtaattcttggaatgctactgtatgggcttcaggggtttataaacctcctgaagttaaatgaagaattatatgtattttttcatctgaactgagaaaagatgttaaaactacagaggataacaaagaaatatatatgtacaactgcctagaattaataatatctcatcatatttgctttggatttttctatatgtaaagcaaataaaacattactgactcagtcgtctccctttcctctttcccccttcagtattttgaacttggtgtggatctttctagtctgtggatttttttaattaatttattaattaatttatttattttttgagatggagtctggctgtatcgcccaggctggagtacagtggaatgatctcagcttactgcaacctcctcctcctgggttcaaacgattctcctgcctcagcctcccgagtagctgggattacgggcgtctaccaccacgccaggctaatttttgtatttttaatagagatggggtttcgctatgttggctaggctggtctcgaactcctgacctcaggtgatccacccgcctcggccttccaaagtgctaggattacaagcatgagccaccacgcccagcctatattttttaaaataatatccacacaaatacatatatgtacacatacacaaataaatgtatagacccccaaatagcagtcttattttgtgtttttgacatttttcttacatggtttcagatatgcgtctttctacaacttgcttctttaccaaacactacccttgtgacacctatgcatattgataccatattatcaaacaagccacatgtatttctcttccaatgaacatttagattgttcctgttttgtttgttctcgtgatctgcggaatgtttatttgttattataaacactgtcagggaaaaggtcagtagcttccaacatattctcagaggactcaggacattctcccatccaaatgttaggaatctctgataatctgatgtggagaaagggcactgtcatcattttgcattgatgcatatttctgcattacagcattcccaagccttgaaggaagctatctttacttacattcttaaaatagcttattagattcttctgcatttaaatctaaaattttctataaggtctgcatcttcctaggacaccaaaaacagccctattattttttcattgaaaatttcttagaatcagataatactgtccaaaatattctgtgaccatgtaatgttatcctaaattgctgtcaacatcaaatggtggtcacaccgaagaaattattaggagactaacaatgtgatattctaattttgttgttgtattctgtaatgtatttaagaattaaacaactaaatctctgttgttctcacattttcctattttctattttttttaatcctagttaagattagagagccttctagtatgactttctttttttttttttttttgagacggagtctcgctgtgtcacccaggctggaatgcagtggcacgatctcggctcactgcaagctccgcctcccaggctcacgccattctcccacctcagcctcctgagtagctgggactactggtgcccaccaccatgcctggctaattttttttgcattgttagtagagacggggtttcaccatgttagccaggatggtctcgatctcctgacctcgtgatccacccgcctcggcctcccaaggtgctgggattacaggcgtgagccaccatgcccggccagtattactttcttttacttttatgcttgctctcactatgacatcttctagtctctatggcaaagtcccaaagcaaggaaattaaaactcagaacactactactcataacagacaatgttcttaagtctaaattatcccctctggtattactgaataaaatcaaccaaaattggtgattttctatcagccttaccttccctcaggagtatgtgaaataatgaaaaagtatacaaatacgtggactcggcattgtcaaatttagaaataatttattgaaccacttttcaaagagcatggacttagcagatctggctggtcacatacaaattgtgtggccctaagtaattcccctcccctcactacactttgattttcttacctgtaaaatggcaataaaaaccaacactggtgctagaatgaaatgaaatcatgtatatggaagccttttgttatcatttctccactatatggggagcttctcataagcagaggcagagagactaattcatctttttggagacggaatcttgctctgtcgcccagactggagtgcagtggcaagatcttggttcaccacaacctctgcctcccatttcaagcgattctcctgcctcagcctcccgagtagctgggattacaggtgcccgccaccccacccagctaatttttttgtatttttagtagagacgggggttttgacatgttggccaggctggtctcgaactcctgacctcaagtgatctgccctcctcggcctcccaaagtgctgggataacaggcctgagccaccatgcccagctctaattcaccaagcctgtatgctaacctcctttgccatggcaatgtcttctctccactttgaggttcaaagctctccatctccatccactcccgttctctggtaagaccactcatatttgccaaggaagacctagaggtctgagtacccactggtgtcacatatttgagtgtcaacgccagaatccagggggagcaccaatggtaggtacctttgggctagaacctgggaatgtggagtatgcatcccaagctcacccaaagagggggcttcttatctcaggagccaaagattaagcagcccattactgaccacagcggttctagtgggtggaaggaggaactctcccctgtacacacttctggaggaagtctccatacagttatgacacacagtgagtaatccggctacatgggattataatactgccaccaaaatataacaaatatgcttatcaagaaaaaggatttgtaaaacaagtggaaaaataacagaacacaaattgtatatttgccccataattacaaccacataaaaacaatgtgtttgaggcccggtgtggtggctcatgcctataatcccagcactttgggaggtcaaggtgggtcacttgaggccaggagttcaagaccagcctggccaacatggtgaaaccctgtccctactaaaaataaaacagttggccgggcatggtagtgtgtacctataatcccagctactcaggaggttgaggcaggagaatcgcttgaaactgggaggcagaaggaggttacagtgagccgagattatgccactgcactccagcctgggcgacagagtgagactccatctcaagaaaaacaaacaaacaaagaaacaatgcatttgaacagactgaaaggaaacccagagacaaaaataattactgtgttagggtgtgggggtactttgggtgaattattctaaatttctttttctttttttttttcttttttgagatgtgccccaggctgtagtgcaatggtgtgatctcggctcactgcaacctcggcctcccaggttcaagcagttctcctgcctcagcctcccaagtagctgagattacaggtgcctgccaccacactcggctaattttttatttttagtagagacagggtttcaccatgttggccaggctggtctcggacttctgacctcaggtgatccctccacctcagccttccaaagtgctgggattacgggcgttagccaccgcgcccggctgaattcttctaaatttcttataatgaagttagtacagtaaccttccacctacaagcagactttcttgaaaagtcccagaaagaaaactatctggtc

SEQ ID NO: 107 - DNA, 3456 bp, Homo sapiens
atagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagac

SEQ ID NO: 108 - DNA, 6201 bp, Homo sapiens
caagcagtgacaaaataaacaccatctgttagtattgacttattccacagcattctcaggctgggtgattttatttcacttttttcagaaatggttaatgacacatctggtagtcagtgaaggtacactctgggtgattaaatgtggtcataagtttacactaaatgctgacagaacatttttttttcttttccattataagcaacggggcacatcggagtgcctggctggctactcattttaaaccttgtgtaggattaactgtttggcggtcgttgaacttccggaaaaacgttgttattttgagtcttctgagaagcagataccaagacaggattaggtatgcaagaaatttattgagggaaacacctgtgaaaactaaagcagaggtgcaggagaaggcgagaacagccttcagatggcaatgtgagtctggcaccagtgaagggagagtgggaaggaaagaggagtgggcaggaagagccccaggcagcagcacattctaaaacagtgtcagccaggacgctggggggtcctggagccccagttgcccatccgagcttttctgcatcctgcataaatgggcatgaattagtttcttcactgtgtccagtcattggcagagaacagacctaggaacctcagtacacacacagtagtggatctgaaggggatagccagtatggccctccatcaactctgttcccacagccagagatccgaggagtgcattttcatggtcaccaaaaatctcaacacaaaaaaatgaaatgatcaccgaattcatttatctctgcatgtctttttaaagaagaaaatacaatatttaaaatggccttttctcccctaatgtctccattggtctagcaggcatggcttgcactgcagaagactagcgtagctggaatagtaggtcccgtttatgctaaattctatcagtgaagggaaaggggagagtcctgaacactgttcttacctcttcatctgttcttttttttctttttttctttttttgagatggagtctcgctctgtctcccaggctggagtgcaatggagcaattttggctcctacaatctccacctcttgggttcaagcgattctcctgcctcagcctcctgagtagctgggattacaggcgtgagccaccatgcccaggctcttcatctcctcttaaactctcagagactctgctgctgctgttaattttgctttcagtgtgaagggttcttttggtttgccataattttgggcccatgacccgggaacttcacctcctatttgaaaagaaaatcatctgggaatggaagaggcgaaatttaggaaaaaaacacacttttttttttttttttttttttttttagtaattcaaaccccaaaacatattttgaggggcagaaggaaaaataattaatgctgtatatgatcacttcctacatgtcaagccattatattgttatcatccttaattcttaaactcttttgagacaagtaaagttatatttttatttacttttatgtatttttttttaagtttaacagaagaggaaagtgaggttcagaaagatctggtgactttttattggcacacaatgagaaagaacagattggggttttttccctgtttttcttgagttggtatacagagtagatttgccaaagagctcctcagttatgccagttactttacttatttgggaaggacttctcatatttatacagatatctttcttcacatcctgaaaagggcactgaacagagagagctgcatgctattaccattttttgcgactaaatacttgtgtggctgtgaattagttatccaggccttggttttttcatctgtaaagaaaggagattgggttagataacatttatcaaacttcagccattttccattttctatcaccttgatttctgtcccatctttaatgccacctataatatattgcttgatattttatttaaaataattcctccttgcaacttaagtgtctttaaaataaaaacattttgtcaccgcttaaaaggaaataccagtataaacaagtaaaattacacacacgcaatcacacacacatatatgtttgtatatatgtatgtacgtatatattcgtatatatgtatatatttgtatatatatccgtatatgcgagtatgtgtgtgtgtgtgtgtgtgtgtgtgtgtgtgtgtgtgtgtgtgtgtagagagagagaggaatataagcaatgaaatgctaggaacaaactgagactttctccttaatataaccagaaactttgaagacaaattgaaaacaaagtatttctaatgaaaatgttctggagacccaaagttgtttgacactttgtcacacttagtatcattttctgggcaaccaatgtcttatactgtgtcagacactggaaaaacatgacttatatattctgtctcacacacttgtgattttcctccctgccccaccccaaccttcatttacctttggcctcattttgcctcatccttccaattgcaaaatttgtaaggaccatctctcctctgactgcagaaatactctctgcatcttggctcatgagtagaaaaaaataagacctggaacaaataagaacaatttcttcctgttcttctgggaagtttcaagggaaggaagtagacagagctcgatagtctgggtaaagcctgaggcaagtcacactgtgtcttccaccagcaggtgtttacccagttaagatcagtttaaattgaatagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagac

SEQ ID NO: 109 - DNA, 5774 bp, Homo sapiens
gcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaac

SEQ ID NO: 110 - DNA, 8020 bp, Homo sapiens
tctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaac

SEQ ID NO: 111 - DNA, 28097 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttt

SEQ ID NO: 112 - DNA, 30931 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttttaacatctgctatagtcctgatgctgaagaatcatggagtcaaaggtttcagcctctttccaagggggagagcacatggacaattaccatctcatgcaggcatttggttttatggactcacatgcttgttacaaaaccagacacagctttagggcttgttattaccttcccccaacccatccttggtagaagacagtcaacaaatgatatctaagctgccaacacatattggaaaatgtttgaaacttgagatctgtggtttattatgaaacacgcagtgccctggagtttgaatttcttcccggttggtcttagtaccctgtctacagattgaggggaaagggcaggaaggggagtaagtgtagttaagagcatagccttggccaggtgcggtgtctcacgcctgtaatcccagcacattgggaggccgaggttggtggatcgcttgaggtcacgagttcaagaccagcctggtcaacatggtgaaacccccatctctactaaaaatacaaaagttagccaggtgtggtggtgggtgcctataatcccagctactcaggaggttgaggcaggagagtcacttgaacccgggaggcagaggtttcagtgagccgagattgtgccactgcattccagcctgggtgacagagtgagactgtctcaaaaaaaaaaaaaaaaaaaaaagagtcaaacagatctgactactacatctgtgatctgtgctaggtcctttcagtggttgaaccttaatggttgtgactctctgtttgctcatatgtaaaatgtggatgatcatagaacctttatcacagatttgtgaagactgcatagcacactccatgaaaagttctccttagcacagcatcaggcacagggaagctcaacgccttgaaggtgctgtttttatttctaggtccctaagatcttcctcgtcctccttatggctcccccctttattctccatatttgttccttccttgaaagtcaagggtgcaggaagaagatgatatcctggaggccaagcccacacaattaggacatgtagtggacatttacctgttcttagatccactgctgctcttcctctgcttgtctatcacaaggggctgacacctgcacactaattctgtcttgagggagactgtgtaggggaacatggccatttgagttcattaggaaagggttttgaggtcaggacatgggtatttggtgtacatgggagtttggtggcctctattgtaggaggctttggaaatgtgtattgttgggaggtcctgagggaggaagtttgggatgaacatggagattctaggctgtggaggaagatgtaacatggctattggaggattctgggaccttaccttggtaccttggtaatgaggacatcttcagctttatttttatgtatttacttttttttgagatggagtctcactctgtcacccaggctcgagtgcagtggcgtgatctcaaaatactaaaaattagctggttgtgttggtgggcacctgtaatcccagctacttgggaagctgaggcaggagaatcgcttgaacctgggaggcagtggttgcagtgagctgagatcatgtggctgcacctcagcctgggtgacagagtgagactctgtctcaaaaaaaaaaaaatgttcatgcctcagctgctcagccagtagtcattcttttctcagtagctgttttctcctcagctttgtggagtctttccctcagcctgtgcagctctgtattcagccaatgatttgaggccactgtaagcagctctttccctttggagctctttttgtaagcaaaagctcagtttcttacgtaagaaaacccaattccccttgaggaagagaaagagctggagtcctttaaaattaactgcctgtttttctgtggctagggagccttatctctccctttgccaggcattgtgaagactctgtttctctagctgtgcagctgcaaggtcactagacagataatctcaagtcgtaaaatatgccgttccttgaaaagtaagaaatgatgtaatgcatgtctcaactggataagtgtctttgtttctcgattctgttttatgcttccccctgcacagatctcctcctgcaccagaagtgcttaaaaggtaactggactctttgtttggggctcagtcattttggatgttgatctgactgggccggtgcacctaaataataataagaaatcctcctcaacccctcagtctctctgattcctaaattatctcactgcaaaggcaagataattgcttgagcccaggagtctgagaccaacctgggcgacatagtgagatcctgtctctacaaaagattaaaaaaattagccgggcattgtggcgcatgcctgtggtcccagctactcgggaggctgaggtggaaggattgcttgagcccaagaggtcctggctatggtgagctatgatcacaccactgccttccagcctgagtgacagagcaagaccttgtctcaaaaaaaaaaaaaaaaaaattgggctgggcatgatggctcaggcctgtaatcccagcactttgggaggctgaggtgggtggatcacctaaggtcaggagttcaagaccagcctgaccaatgtggtgaaaccctgtctctactgaaaaatacaaaaattagccaggtgtggttgtgtgcacctgtagtcccagctactcgggaggctgagacaggggcctaggattaaataaggagttttggcaaaactaggctggaactccaaaacctgctacgtaagtactcacgagggttgctagttattagtattattactttgttgttatttttaggagtggagca

SEQ ID NO: 113 - DNA, 85 bp, Homo sapiens
agttatttgtgccaaattagtaatgtgaatttgggaactatcagtcttttctatggcccggaataatttaaataatagaaattat

SEQ ID NO: 114 - DNA, 6393 bp, Homo sapiens
ccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgta

SEQ ID NO: 115 - DNA, 10532 bp, Homo sapiens
ccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtatt
